United States Patent
Halbert et al.

(10) Patent No.: US 9,958,448 B2
(45) Date of Patent: May 1, 2018

(54) APTAMERS AND USES THEREOF

(71) Applicant: CARIS LIFE SCIENCES SWITZERLAND HOLDINGS, S.A.R.L., Basel (CH)

(72) Inventors: David Halbert, Colleyville, TX (US); Valeriy Domenyuk, Tempe, AZ (US); David Spetzler, Paradise Valley, AZ (US); Tassilo Hornung, Tempe, AZ (US); Frank Schafer, Düsseldorf (DE); Nianqing Xiao, Rockville, MD (US)

(73) Assignee: Caris Life Sciences Switzerland Holdings GMBH, Basel (CH)

( * ) Notice: Subject to any disclaimer, the term of this patent is extended or adjusted under 35 U.S.C. 154(b) by 0 days. days.

(21) Appl. No.: 14/438,172

(22) PCT Filed: Oct. 23, 2013

(86) PCT No.: PCT/IB2013/003092
§ 371 (c)(1),
(2) Date: Apr. 23, 2015

(87) PCT Pub. No.: WO2014/068408
PCT Pub. Date: May 8, 2014

(65) Prior Publication Data
US 2016/0003835 A1 Jan. 7, 2016

Related U.S. Application Data

(60) Provisional application No. 61/874,621, filed on Sep. 6, 2013, provisional application No. 61/871,107, filed on Aug. 28, 2013, provisional application No. 61/867,978, filed on Aug. 20, 2013, provisional application No. 61/866,014, filed on Aug. 14, 2013, provisional application No. 61/863,828, filed on Aug. 8, 2013, provisional application No. 61/862,809, filed on Aug. 6, 2013, provisional application No. 61/843,256, filed on Jul. 5, 2013, provisional application No. 61/838,762, filed on Jun. 24, 2013, provisional application No. 61/826,957, filed on May 23, 2013, provisional application No. 61/820,419, filed on May 7, 2013, provisional application No. 61/808,144, filed on Apr. 3, 2013, provisional application No. 61/805,365, filed on Mar. 26, 2013, provisional application No. 61/769,064, filed on Feb. 25, 2013, provisional application No. 61/767,131, filed on Feb. 20, 2013, provisional application No. 61/754,471, filed on Jan. 18, 2013, provisional application No. 61/750,331, filed on Jan. 8, 2013, provisional application No. 61/749,773, filed on Jan. 7, 2013, provisional application No. 61/748,437, filed on Jan. 2, 2013, provisional application No. 61/735,915, filed on Dec. 11, 2012, provisional application No. 61/731,419, filed on Nov. 29, 2012, provisional application No. 61/717,566, filed on Oct. 23, 2012.

(51) Int. Cl.
*G01N 33/574* (2006.01)
*C12N 15/115* (2010.01)

(52) U.S. Cl.
CPC ..... *G01N 33/57492* (2013.01); *C12N 15/115* (2013.01); *C12N 2310/16* (2013.01); *C12N 2310/344* (2013.01); *C12N 2320/13* (2013.01); *G01N 2800/50* (2013.01)

(58) Field of Classification Search
None
See application file for complete search history.

(56) References Cited

U.S. PATENT DOCUMENTS

| | | | |
|---|---|---|---|
| 4,275,149 A | 6/1981 | Litman | |
| 4,551,435 A | 11/1985 | Liberti | |
| 4,666,828 A | 5/1987 | Gusella | |
| 4,683,202 A | 7/1987 | Mullis | |
| 4,737,456 A | 4/1988 | Weng | |
| 4,795,698 A | 1/1989 | Owen | |
| 4,801,531 A | 1/1989 | Frossard | |

(Continued)

FOREIGN PATENT DOCUMENTS

| | | |
|---|---|---|
| JP | 2007-014292 A | 1/2007 |
| WO | WO/1999/005255 | 3/1999 |

(Continued)

OTHER PUBLICATIONS

Altschul S F, et al, Basic local alignment search tool. J Mol. Biol. 1990; 215(3):403-10.
Altschul S F, et al, Gapped BLAST and PSI-BLAST: a new generation of protein database search programs. Nucleic Acids Res. 1997; 25(17):3389-402.
Arnold, S, et al. One round of SELEX for the generation of DNA aptamers directed against KLK6. Biol Chem. Apr. 1, 2012;393(5):343-53.
Bennet, Current Drug Discovery; Feb. 2004; pp. 15-19.
BioIT-World. Solexa History. 2010. Available at http://www.bioitworld.com/2010/issues/sept-oct/solexa.html.
Blank M et al., Systematic evolution of a DNA aptamer binding to rat brain tumor microvessels. Selective targeting of endothelial regulatory protein pigpen. J Biol Chem. May 11, 2001;276(19):16464-8. Epub Feb. 13, 2001.
Branton et al., The potential and challenges of nanopore sequencing, 26:1146-1153 (2008). Published online Oct. 9, 2008; doi:10.1038/nbt.1495.

(Continued)

*Primary Examiner* — James Martinell
(74) *Attorney, Agent, or Firm* — Jeffrey G. Thomas

(57) ABSTRACT

Methods and compositions are provided for specific aptamers and aptamer pools that bind biomarkers of interest such as microvesicle surface antigens or functional fragments of microvesicle surface antigens. In various embodiments, aptamers of the invention are used in diagnostic, prognostic, or theranostic processes to screen a biological sample for the presence or levels of biomarkers such as microvesicles that are determined to provide a diagnostic, prognostic, or theranostic readout. The diagnosis, prognosis, or theranosis may be related to cancer or other diseases and disorders. The invention also provides methods and composition to facilitate aptamer library screening and aptamer detection methods.

18 Claims, 78 Drawing Sheets

(56) References Cited

U.S. PATENT DOCUMENTS

| | | |
|---|---|---|
| 4,925,788 A | 5/1990 | Liberti |
| 5,108,933 A | 4/1992 | Liberti |
| 5,158,871 A | 10/1992 | Rossomando |
| 5,186,827 A | 2/1993 | Liberti |
| 5,192,659 A | 3/1993 | Simons |
| 5,200,084 A | 4/1993 | Liberti |
| 5,270,163 A | 12/1993 | Gold |
| 5,272,057 A | 12/1993 | Smulson |
| 5,376,252 A | 12/1994 | Ekstrom |
| 5,434,064 A | 7/1995 | Schlessinger |
| 5,475,096 A | 12/1995 | Gold |
| 5,496,938 A | 3/1996 | Gold |
| 5,567,588 A | 10/1996 | Gold |
| 5,580,737 A | 12/1996 | Polisky |
| 5,637,459 A | 6/1997 | Burke |
| 5,648,214 A | 7/1997 | Nieuwlandt |
| 5,650,275 A | 7/1997 | Pitner |
| 5,660,985 A | 8/1997 | Pieken |
| 5,672,695 A | 9/1997 | Eckstein |
| 5,683,867 A | 11/1997 | Biesecker |
| 5,698,687 A | 12/1997 | Eckstein |
| 5,705,337 A | 1/1998 | Gold |
| 5,707,796 A | 1/1998 | Gold |
| 5,712,375 A | 1/1998 | Jensen |
| 5,736,330 A | 4/1998 | Fulton |
| 5,756,287 A | 5/1998 | Allen |
| 5,763,177 A | 6/1998 | Gold |
| 5,763,566 A | 6/1998 | Jensen |
| 5,789,157 A | 8/1998 | Jensen |
| 5,789,163 A | 8/1998 | Drolet |
| 5,817,635 A | 10/1998 | Eckstein |
| 5,853,984 A | 12/1998 | Davis |
| 5,861,254 A | 1/1999 | Schneider |
| 5,864,026 A | 1/1999 | Jensen |
| 5,958,691 A | 9/1999 | Pieken |
| 6,011,020 A | 1/2000 | Gold |
| 6,013,443 A | 1/2000 | Heilig |
| 6,051,698 A | 4/2000 | Janjic |
| 6,057,107 A | 5/2000 | Fulton |
| 6,114,120 A | 9/2000 | Jensen |
| 6,180,348 B1 | 1/2001 | Li |
| 6,287,765 B1 | 9/2001 | Cubicciotti |
| 6,309,822 B1 | 10/2001 | Fodor |
| 6,329,145 B1 | 12/2001 | Janjic |
| 6,329,209 B1 | 12/2001 | Wagner |
| 6,365,418 B1 | 4/2002 | Wagner |
| 6,376,190 B1 | 4/2002 | Gold |
| 6,376,474 B1 | 4/2002 | Heilig |
| 6,379,698 B1 | 4/2002 | Leamon |
| 6,387,620 B1 | 5/2002 | Smith |
| 6,406,921 B1 | 6/2002 | Wagner |
| 6,408,878 B2 | 6/2002 | Unger |
| 6,423,493 B1 | 7/2002 | Gorenstein |
| 6,475,808 B1 | 11/2002 | Wagner |
| 6,475,809 B1 | 11/2002 | Wagner |
| 6,506,887 B1 | 1/2003 | Smith |
| 6,544,776 B1 | 4/2003 | Gold |
| 6,569,620 B1 | 5/2003 | Gold |
| 6,599,331 B2 | 7/2003 | Chandler |
| 6,613,526 B2 | 9/2003 | Heilig |
| 6,623,526 B1 | 9/2003 | Lloyd |
| 6,645,432 B1 | 11/2003 | Anderson |
| 6,706,481 B2 | 3/2004 | Rajendran |
| 6,716,580 B2 | 4/2004 | Gold |
| 6,719,868 B1 | 4/2004 | Schueller |
| 6,762,025 B2 | 7/2004 | Cubicciotti |
| 6,773,812 B2 | 8/2004 | Chandler |
| 6,787,308 B2 | 9/2004 | Balasubramanian |
| 6,793,753 B2 | 9/2004 | Unger |
| 6,864,048 B2 | 3/2005 | Fodor |
| 6,867,289 B1 | 3/2005 | Gorenstein |
| 6,899,137 B2 | 5/2005 | Unger |
| 6,929,030 B2 | 8/2005 | Unger |
| 6,962,784 B2 | 11/2005 | Janjic |
| 6,986,902 B1 | 1/2006 | Chen |
| 7,040,338 B2 | 5/2006 | Unger |
| 7,074,586 B1 | 7/2006 | Cheronis |
| 7,083,958 B2 | 8/2006 | Sligar |
| 7,118,661 B2 | 10/2006 | Surh |
| 7,118,910 B2 | 10/2006 | Unger |
| 7,125,711 B2 | 10/2006 | Pugia |
| 7,135,147 B2 | 11/2006 | Cox |
| 7,138,062 B2 | 11/2006 | Yin |
| 7,141,978 B2 | 11/2006 | Peck |
| 7,144,616 B1 | 12/2006 | Unger |
| 7,160,856 B2 | 1/2007 | Danishefsky |
| 7,189,368 B2 | 3/2007 | Andersson |
| 7,189,580 B2 | 3/2007 | Beebe |
| 7,189,581 B2 | 3/2007 | Beebe |
| 7,195,986 B1 | 3/2007 | Bousse |
| 7,201,881 B2 | 4/2007 | Cox |
| 7,216,671 B2 | 5/2007 | Unger |
| 7,229,538 B2 | 6/2007 | Tseng |
| 7,233,865 B2 | 6/2007 | Chien |
| 7,238,255 B2 | 7/2007 | Derand |
| 7,238,324 B2 | 7/2007 | Ko |
| 7,250,128 B2 | 7/2007 | Unger |
| 7,253,003 B2 | 8/2007 | Beebe |
| 7,258,837 B2 | 8/2007 | Yager |
| 7,261,824 B2 | 8/2007 | Schlautmann |
| 7,274,316 B2 | 9/2007 | Moore |
| 7,288,368 B2 | 10/2007 | Zweig |
| 7,323,140 B2 | 1/2008 | Handique |
| 7,329,391 B2 | 2/2008 | Cox |
| 7,338,637 B2 | 3/2008 | Pease |
| 7,338,762 B2 | 3/2008 | Gorenstein |
| 7,348,184 B2 | 3/2008 | Rich |
| 7,351,380 B2 | 4/2008 | Simmons |
| 7,351,592 B2 | 4/2008 | Storek |
| 7,357,864 B2 | 4/2008 | Takada |
| 7,371,404 B2 | 5/2008 | Panzner |
| 7,381,471 B2 | 6/2008 | Augustine |
| 7,390,463 B2 | 6/2008 | He |
| 7,399,600 B2 | 7/2008 | Carr |
| 7,399,632 B2 | 7/2008 | Simmons |
| 7,402,229 B2 | 7/2008 | Sibbett |
| 7,407,947 B2 | 8/2008 | Panzner |
| 7,411,184 B2 | 8/2008 | Sarrut |
| 7,413,709 B2 | 8/2008 | Roitman |
| 7,419,639 B2 | 9/2008 | Osterfeld |
| 7,419,822 B2 | 9/2008 | Jeon |
| 7,422,669 B2 | 9/2008 | Jacobson |
| 7,422,725 B2 | 9/2008 | Kimizuka |
| 7,431,887 B2 | 10/2008 | Storek |
| 7,445,844 B2 | 11/2008 | Chandler |
| 7,449,096 B2 | 11/2008 | Berndt |
| 7,452,509 B2 | 11/2008 | Cox |
| 7,452,713 B2 | 11/2008 | Barlocchi |
| 7,467,928 B2 | 12/2008 | Fakunle |
| 7,485,214 B2 | 2/2009 | Palmieri |
| 7,488,596 B2 | 2/2009 | Lee |
| 7,494,555 B2 | 2/2009 | Unger |
| 7,501,245 B2 | 3/2009 | Quake |
| 7,514,400 B2 | 4/2009 | Peterson |
| 7,518,726 B2 | 4/2009 | Rulison |
| 7,541,578 B2 | 6/2009 | Weng |
| 7,544,506 B2 | 6/2009 | Breidford |
| 7,552,741 B2 | 6/2009 | Yamada |
| 7,568,399 B2 | 8/2009 | Sparks |
| 7,575,722 B2 | 8/2009 | Arnold |
| 7,579,136 B2 | 8/2009 | Shim |
| 7,581,429 B2 | 9/2009 | Sparks |
| 7,591,936 B2 | 9/2009 | Sarrut |
| 7,601,270 B1 | 10/2009 | Unger |
| 7,611,863 B2 | 11/2009 | Fromherz |
| 7,640,947 B2 | 1/2010 | Fernandes |
| 7,666,361 B2 | 2/2010 | McBride |
| 7,678,574 B2 | 3/2010 | Blake |
| 7,691,333 B2 | 4/2010 | McBride |
| 7,704,735 B2 | 4/2010 | Facer |
| 7,751,053 B2 | 7/2010 | Carr |
| 7,754,010 B2 | 7/2010 | Unger |
| 7,819,796 B2 | 10/2010 | Blake |
| 7,855,054 B2 | 12/2010 | Schneider |

(56) References Cited

U.S. PATENT DOCUMENTS

| | | | |
|---|---|---|---|
| 7,858,117 B2 | 12/2010 | Panzner | |
| 7,867,763 B2 | 1/2011 | Facer | |
| 7,888,035 B2 | 2/2011 | Klass | |
| 7,897,356 B2* | 3/2011 | Klass | C12Q 1/6886 435/7.1 |
| 7,947,447 B2 | 5/2011 | Zichi | |
| 7,947,647 B2 | 5/2011 | Peterson | |
| 7,955,802 B2 | 6/2011 | Whitman | |
| 8,008,019 B2 | 8/2011 | Merante | |
| 8,013,131 B2 | 9/2011 | Bovin | |
| 8,048,448 B2 | 11/2011 | Ludwig | |
| 8,071,288 B2 | 12/2011 | Gold | |
| 8,088,601 B2 | 1/2012 | Fox | |
| 8,124,015 B2 | 2/2012 | Diercks | |
| 8,143,004 B2 | 3/2012 | Ikebukuro | |
| 8,198,230 B2 | 6/2012 | Peterson | |
| 8,216,784 B2 | 7/2012 | Taylor | |
| 8,329,404 B2 | 12/2012 | McKernan | |
| 8,367,627 B2 | 2/2013 | Sullenger | |
| 8,409,795 B2 | 4/2013 | Schneider | |
| 8,455,199 B2 | 6/2013 | Marsh | |
| 8,492,082 B2 | 7/2013 | Franciscis | |
| 8,587,214 B2 | 11/2013 | Niedermeier | |
| 8,598,139 B2 | 12/2013 | Fitzgerald | |
| 8,768,629 B2 | 7/2014 | Von Hoff | |
| 8,841,095 B2 | 9/2014 | Shuber | |
| 8,945,830 B2 | 2/2015 | Heil | |
| 8,975,026 B2 | 3/2015 | Zichi | |
| 8,975,215 B2 | 3/2015 | Park | |
| 9,012,498 B2 | 4/2015 | Manoharan | |
| 9,128,101 B2 | 9/2015 | Halbert | |
| 9,469,876 B2 | 10/2016 | Kuslich | |
| 9,758,811 B2 | 9/2017 | Brown | |
| 2003/0061687 A1 | 4/2003 | Hansen | |
| 2003/0087239 A1 | 5/2003 | Stanton | |
| 2003/0219801 A1 | 11/2003 | Lipshultz | |
| 2004/0197804 A1 | 10/2004 | Keefe | |
| 2005/0037394 A1 | 2/2005 | Keefe | |
| 2005/0084421 A1 | 4/2005 | Unger | |
| 2005/0123939 A1 | 6/2005 | Gorenstein | |
| 2005/0142582 A1 | 6/2005 | Doyle | |
| 2005/0145496 A1 | 7/2005 | Goodsaid | |
| 2005/0158708 A1 | 7/2005 | Alroy | |
| 2005/0201901 A1 | 9/2005 | Grossman | |
| 2005/0252773 A1 | 11/2005 | McBride | |
| 2006/0006067 A1 | 1/2006 | Unger | |
| 2006/0068388 A1 | 3/2006 | Barberis | |
| 2007/0166741 A1 | 7/2007 | Heil | |
| 2007/0172873 A1 | 7/2007 | Brenner | |
| 2008/0254446 A1 | 10/2008 | Sode | |
| 2008/0261204 A1 | 10/2008 | Lexow | |
| 2009/0062129 A1 | 3/2009 | McKernan | |
| 2009/0264508 A1 | 10/2009 | Sullenger | |
| 2009/0305237 A1 | 12/2009 | Cantor | |
| 2009/0305254 A1 | 12/2009 | Sode | |
| 2009/0325153 A1 | 12/2009 | Shuber | |
| 2010/0070191 A1 | 3/2010 | Gold | |
| 2010/0086948 A1 | 4/2010 | Gold | |
| 2010/0111768 A1 | 5/2010 | Banerjee | |
| 2010/0196426 A1 | 8/2010 | Skog | |
| 2010/0221752 A2 | 9/2010 | Gold | |
| 2010/0254901 A1 | 10/2010 | Smith | |
| 2010/0298151 A1* | 11/2010 | Taylor | C12Q 1/6809 506/2 |
| 2011/0059867 A1 | 3/2011 | Kim | |
| 2011/0263459 A1 | 10/2011 | Borer | |
| 2011/0275794 A1 | 11/2011 | Rohloff | |
| 2012/0077695 A1 | 3/2012 | Ostroff | |
| 2012/0101002 A1 | 4/2012 | Riel-Mehan | |
| 2012/0101148 A1 | 4/2012 | Akinc | |
| 2012/0178917 A1 | 7/2012 | Sullenger | |
| 2012/0264810 A1 | 10/2012 | Lin | |
| 2012/0289411 A1 | 11/2012 | Hatakeyama | |
| 2013/0029339 A1 | 1/2013 | Skog | |
| 2013/0116129 A1 | 5/2013 | Miyagishi | |
| 2013/0203061 A1 | 8/2013 | Kuslich | |
| 2013/0217582 A1 | 8/2013 | Borer | |
| 2014/0141986 A1 | 5/2014 | Spetzler | |
| 2014/0148348 A1 | 5/2014 | Kuslich | |
| 2014/0148350 A1 | 5/2014 | Spetzler | |
| 2014/0220580 A1 | 8/2014 | Brown | |
| 2014/0228233 A1 | 8/2014 | Pawlowski | |
| 2015/0152474 A1 | 6/2015 | Pawlowski | |
| 2015/0024952 A1 | 8/2015 | Ootaka | |
| 2015/0301058 A1 | 10/2015 | Schettini | |
| 2016/0003835 A1 | 1/2016 | Halbert | |
| 2016/0186266 A1 | 6/2016 | Alarcon | |
| 2016/0319361 A1 | 11/2016 | Spetzler | |

FOREIGN PATENT DOCUMENTS

| | | |
|---|---|---|
| WO | WO/2007/032359 | 3/2007 |
| WO | WO/2010/072410 | 7/2010 |

OTHER PUBLICATIONS

Brenner et al., Gene expression analysis by massively parallel signature sequencing (MPSS) on micro bead arrays, Nat Biotechnol. Jun. 2000;18(6):630-4.

Brody and Gold, Aptamers as therapeutic and diagnostic agents. Rev. Mol. Biotech. 2000, 74:5-13.

Brody et al., Life's Simple Measures: Unlocking the Proteome, J. Mol. Biol. (2012) 422, 595-606.

Bruno et al. Development of DNA aptamers for cytochemical detection of acetylcholine. In Vitro Cell Dev Biol Anim. Mar.-Apr. 2008;44(3-4):63-72.

Caras et al., Signal peptide for protein secretion directing glycophospholipid membrane anchor attachment, Science, vol. 243:1196-1198 (1989).

Cerchia et al., Minireview: Nucleic acid aptamers in cancer medicine, FEBS Letters 528 (2002) pp. 12-16.

Cerchia, L., and V. de Franciscis. Nucleic Acid Aptamers Against Protein Kinases. Current medicinal chemistry 18.27 (2011): 4152-4158.

Chang YM et al., Using aptamers for cancer biomarker discovery. J Nucleic Acids. 2013;2013:817350. doi: 10.1155/2013/817350. Epub Jan. 15, 2013.

Charras and Palluch, Blebs lead the way: how to migrate without lamellipodia. Nature Reviews Molecular and Cell Biology, vol. 9, No. 11, p. 730-736 (2008).

Chaudry MA, et al. (Apr. 2007). EpCAM an immunotherapeutic target for gastrointestinal malignancy: current experience and future challenges. Br J Cancer. Apr. 10, 2007;96(7):1013-9.

Chen et al., Aptamer-mediated nanoparticle-based protein labeling platform for intracellular imaging and tracking endocytosis dynamics. Anal Chem. Apr. 3, 2012;84(7):3099-110.

Chen et al., Microfluidic isolation and transcriptome analysis of serum vesicles, Lab on a Chip, Dec. 8, 2009 DOI: 10.1039/b916199f, 10(4), 505 (2010).

Cho et al., Optimization of aptamer microarray technology for multiple protein targets, Analytica Chimica Acta 564 (2006) 82-90.

Colcher, et al. (1999) Effects of genetic engineering on the pharmacokinetics of antibodies, Q. J. Nucl. Med., 43: 132-139.

Cotten, et al., 2'-O-methyl, 2'-O-ethyl oligoribonucleotides and phosphorothioate oligodeoxyribonucleotides as inhibitors of the in vitro U7 snRNP-dependent mRNA processing event. Nucl. Acid Res. 19:2629-2635 (1991).

Cutillas et al. Proteomic analysis of plasma membrane vesicles isolated from the rat renal cortex. Proteomics, 2005;5:101-112.

Cutillas et al., Quantification of gel-separated proteins and their phosphorylation sites by LC-MS using unlabeled internal standards: analysis of phosphoprotein dynamics in a B cell lymphoma cell line. Mol Cell Proteomics 2005;4:1038-1051.

Dear, One by one: Single molecule tools for genomics. Brief Funct Genomic Proteomic 2003; 1: 397-416.

Dua P, et al. Patents on SELEX and therapeutic aptamers. Recent Pat DNA Gene Seq. 2008;2(3):172-86.

Dua P, et al., Nucleic acid aptamers targeting cell-surface proteins, Methods 54 (2011) 215-225.

(56) References Cited

OTHER PUBLICATIONS

Ellington & Szostak, In vitro selection of RNA molecules that bind specific ligands, Nature 346:818-822, (1990).
Elrick et al., Proteomics: Recent Applications and New Technologies, Basic & Clinical Pharmacology & Toxicology 2006, 98, 432-441.
Erlandsen, et al. High resolution backscatter electron (bse) imaging of immunogold with in-lens and below-the-lens field emission scanning electron microscopes. Scanning Microscopy 13:43-54 (1999).
ExoQuick™ Exosome Precipitation Solution User Manual, System Biosciences (SBI), Palo Alto CA, Version 10 Jan. 30, 2017.
Fan et al., Highly Parallel Genomic Assays, Nature Reviews, Genetics, 7:632-644 (2006).
Ferreira CS et al, DNA aptamers against the MUC1 tumour marker: design of aptamer-antibody sandwich ELISA for the early diagnosis of epithelial tumours, Anal Bioanal Chem. Feb. 2008;390(4):1039-50.
Ferreira CS et al, DNA Aptamers That Bind to MUC1 Tumour Marker: Design and Characterization of MUC1-Binding Single-Stranded DNA Aptamers, Tumour Biol. 2006;27(6):289-301.
Froehler et al., Synthesis of DNA via deoxynucleoside H-phosphonate intermediates. Nucleic Acids Res. Jul. 11, 1986;14(13):5399-407.
Froehler, Deoxynucleoside H-Phosphonate diester intermediates in the synthesis of internucleotide phosphate analogues. Tetrahedron Lett. 27:5575-5578 (1986).
Graham JC and Zarbl H (2012) Use of Cell-SELEX to Generate DNA Aptamers as Molecular Probes of HPV-Associated Cervical Cancer Cells. PLoS One 7(4).
Haimovich, Methods, challenges, and promise of next-generation sequencing in cancer biology. Yale J Biol Med. Dec. 2011;84(4):439-46.
Hamedani, N. et al. Selection of high affinity DNA-aptamer for activated protein C using capillary electrophoresis. Research in Pharmaceutical Sciences 7.5 (2012): S987.
Harris TD et al. Single-molecule DNA sequencing of a viral genome. 2008 Science, 320, 106-109.
Hicke, B. J., Stephens, A. W., Escort aptamers: a delivery service for diagnosis and therapy, J. Clin. Invest., 106:923-928 (2000).
Hirose et al., Rapid synthesis of trideoxyribonucleotide blocks. Tetrahedron Lett. 1978; 19(28): 2449-2452.
Hobbs, et al., Polynucleotides containing 2'-amino-2'-deoxyribose and 2'-azido-2'-deoxyribose. Biochemistry 12:5138-5145 (1973).
Hofacker et al., Fast folding and comparison of RNA secondary structures. Monatshefte für Chemie. 125: 167-188 (1994).
Hofacker, I. L. Vienna RNA secondary structure server. Nucleic Acids Res. 31, 3429-3431 (2003).
Huang et al. Integrated microfluidic system for rapid screening of CRP aptamers utilizing systematic evolution of ligands by exponential enrichment (SELEX). Biosens Bioelectron. 2010, vol. 25(7), p. 1761-1766.
Hussey, Stephen L., et al., A Synthetic Membrane-Anchored Antigen Efficiently Promotes Uptake of Antifluorescein Antibodies and Associated Protein a by Mammalian Cells, J. Am. Chem. Soc., 2001, vol. 123, pp. 12712-12713.
International Preliminary Report on Patentability for PCT/GB2008/003447, dated Apr. 13, 2010.
International Search Report for PCT/IB13/03092, dated Sep. 1, 2014.
International Search Report for PCT/US13/76611, dated Mar. 31, 2014.
International Search Report for PCT/US14/53306, dated Mar. 24, 2015.
Jain KK: Integrative Omics, Pharmacoproteomics, and Human Body Fluids. In: Thongboonkerd V, ed., ed. Proteomics of Human Body Fluids: Principles, Methods and Applications. vol. 1: Totowa, N.J.: Humana Press, 2007, pp. 175-192.
Janas and Janas, The selection of aptamers specific for membrane molecular targets. Cell Mol Biol Lett. Mar. 2011;16(1):25-39.
Jayasena SD, Aptamers: an emerging class of molecules that rival antibodies in diagnostics. Clin Chem. Sep. 1999;45(9):1628-50.
Kanwar JR et al., Chimeric aptamers in cancer cell-targeted drug delivery, Crit Rev Biochem Mol Biol. Dec. 2011;46(6):459-77.
Kartalov EP et al., High-throughput multi-antigen microfluidic fluorescence immunoassays. Biotechniques 2006; 40(1):85-90.
Kasschau et al., Genome-wide profiling and analysis of *Arabidopsis* siRNAs, PLoS Biol (2007) 5(3):e57.
Kaur H, Yung L-YL (2012) Probing High Affinity Sequences of DNA Aptamer against VEGF165. PLoS One 7(2): e31196. doi:10.1371/journal.pone.0031196.
Kellar, K.L. and J.P. Douglass, 2003, Multiplexed microsphere-based flow cytometric immunoassays for human cytokines. Journal of Immunological Methods, 279: 277-285.
Kellar, K.L. and M.A. Iannone, 2002, Multiplexed microsphere-based flow cytometric assays. Experimental Hematology, 30: 1227-1237.
Kellar, K.L., 2003, Applications of multiplexed fluorescent microsphere-based assays to studies of infectious disease. Journal of Clinical Ligand Assay, 26:76-86.
Kellar, K.L., et al, 2001, Multiplexed fluorescent bead-based immunoassays for quantitation of human cytokines in serum and culture supernatants. Cytometry, 45: 27-36.
Keller et al., Exosomes: From biogenesis and secretion to biological function, Immunol. Lett. 107 (2): 102-8 (2006).
Kim, JW et al., Identification of DNA Aptamers toward Epithelial Cell Adhesion Molecule via Cell-SELEX, Mol. Cells 2014; 37(10): 742-746.
Klug and Famulok. All you wanted to know about SELEX. Mol Biol Rep. 1994, vol. 20(2), p. 97-107.
Kulbachinskiy, Methods for Selection of Aptamers to Protein Targets, Biochemistry (Moscow), 73:1505-1518 (2007).
Lee et al., Biomarker Assay Translation from Discovery to Clinical Studies in Cancer Drug Development: Quantification of Emerging Protein Biomarkers, Adv Cancer Res. (2007) 96:269-98.
Li et al., The Oral Fluid MEMS/NEMS Chip (OFMNC): diagnostic and translational applications. Adv Dent Res 18(1): 3-5 (2005).
Lin et al., Expression of T Cell Antigen Receptor Heterodimers in a Lipid-Linked Form, Science Reports, 1990; 249:677-679.
Liu et al. (2008) TiGER: a database for tissue-specific gene expression and regulation. BMC Bioinformatics. 9:271.
Lu et al., Elucidation of the Small RNA Component of the Transcriptome, Science. Sep. 2, 2005;309(5740):1567-9.
Margulies, M. et al. Genome Sequencing in Open Microfabricated High Density Picoliter Reactors. 2005 Nature 437, (376-380).
Martins, T.B, 2002, Development of internal controls for the Luminex instrument as part of a multiple seven-analyte viral respiratory antibody profile. Clin Diagn Lab Immunol, 9: 41-45.
Martins, T.B., et al., 2004, Heterophile antibody interference in a multiplexed fluorescent microsphere immunoassay for quantitation of cytokines in human serum. Clin Diagn Lab Immunol. Mar. 2004;11(2):325-9.
Mathews, D., et al. Expanded sequence dependence of thermodynamic parameters improves prediction of RNA secondary structure. J. Mol. Biol. 288, 911-940 (1999).
Mayer et al. Fluorescence-activated cell sorting for aptamer SELEX with cell mixtures. Nat Protoc. 2010, vol. 5(12), p. 1993-2004.
Mehan et al., Highly Multiplexed Proteomic Platform for Biomarker Discovery, Diagnostics, and Therapeutics, Adv Exp Med Biol. (2013) 734:283-300.
Mei et al., Functional-Group Specific Aptamers Indirectly Recognizing Compounds with Alkyl Amino Group, Anal. Chem. 2012, 84, 7323-7329.
Mere L, et al.,Miniaturized FRET assays and microfluidics: key components for ultra-high-throughput screening, Drug Discovery Today 4(8):363-369 (1999).
Metzker, Sequencing technologies—the next generation. Nat Rev Genet. Jan. 2010;11(1):31-46.
Mitkevich, Olga V., et al. DNA aptamers detecting generic amyloid epitopes. Prion 6.4 (2012): 400-406.
Morris KN et al., High affinity ligands from in vitro selection: complex targets. Proc Natl Acad Sci U S A. Mar. 17, 1998;95(6):2902-7.

(56) References Cited

OTHER PUBLICATIONS

Nagarkatti et al., Development of an aptamer-based concentration method for the detection of Trypanosoma cruzi in blood. PLoS One. 2012;7(8):e43533.
Nida et al., Fluorescent nanocrystals for use in early cervical cancer detection. Gynecologic Oncology 2005;4, S89-S94.
Nizard et al., Anchoring Antibodies to Membranes Using a Diphtheria Toxin T Domain-ZZ Fusion Protein as a pH Sensitive Membrane Anchor, FEBs Letters 433:83-88, 1998.
Nizard et al., Prolonged Display or Rapid Internalization of the IgG-Binding Protein ZZ Anchored to the Surface of Cells Using the Diphtheria Toxin T Domain, Protein Engineering 14(6):439-446, 2001.
Non-final Office Action for U.S. Appl. No. 14/652,728 dated Jun. 28, 2017.
Ohuchi S., Cell-SELEX Technology, Biores Open Access. Dec. 2012;1(6):265-72.
Pan and Clawson, Primer-free aptamer selection using a random DNA library. Methods Mol Biol. 2010;629, 367-383.
Parameswaran et al., A pyrosequencing-tailored nucleotide barcode design unveils opportunities for large-scale sample multiplexing, Nucleic Acids Res. 2007;35(19):e130. Epub Oct. 11, 2007.
Pipper et al., Clockwork PCR including sample preparation. Angewandte Chemie, 47(21), p. 3900-3904 (2008).
Pohl and Shih. Principle and applications of digital PCR. Expert Rev Mol Diagn. Jan. 2004;4(1):41-7.
Reff and Heard, A review of modifications to recombinant antibodies: attempt to increase efficacy in oncology applications. Critical Reviews in Oncology/Hematology, 40 (2001):25-35.
Reinartz et al., Massively parallel signature sequencing (MPSS) as a tool for in-depth quantitative gene expression profiling in all organisms, Brief Funct Genomic Proteomic. Feb. 2002;1(1):95-104.
Rieu S et al., Exosomes released during reticulocyte maturation bind to fibronectin via integrin alpha4beta1. Eur J Biochem. Jan. 2000;267(2):583-90.
Robinson and Smyth, Moderated statistical tests for assessing differences in tag abundance, Bioinformatics. Nov. 1, 2007;23(21):2881-7. Epub Sep. 19, 2007.
Rokhlin et al., 5E10: a prostate-specific surface-reactive monoclonal antibody. Cancer Lett. 1998 131:129-36).
Ruby et al., Large-scale sequencing reveals 21U-RNAs and additional microRNAs and endogenous siRNAs in C. elegans, Cell (2006) 127:1193-1207.
Ruff, et al, Real-Time PCR-Coupled CE-SELEX for DNA Aptamer Selection. ISRN Molecular Biology, vol. 2012, published 2012.
Schorey and Bhatnagar. Exosome function: from tumor immunology to pathogen biology. Traffic. Jun. 2008;9(6):871-81.
Schuster, Next-generation sequencing transforms today's biology, Nature Methods 5:16-18 (2008).
Sefah et al., Development of DNA aptamers using Cell-SELEX. Nat Protoc. Jun. 2010;5(6):1169-85.
Shendure et al., Advanced sequencing technologies: methods and goals. Nat Rev Genet. May 2004;5(5):335-44.
Shigdar S et al. RNA aptamer against a cancer stem cell marker epithelial cell adhesion molecule. Cancer Sci. May 2011;102(5):991-8.
Soni G V and Meller A. Progress toward ultrafast DNA sequencing using solid-state nanopores. 2007 Clin Chem 53: 1996-2001.
Sood and Narang, A rapid and convenient synthesis of polythymidylic acid by the modified triester approach. Nucleic Acids Res. Aug. 1977;4(8):2757-65.
Sproat, et al., New synthetic routes to synthons suitable for 2'-O-allyloligoribonucleotide assembly. Nucl. Acid Res. 19:733-738 (1991).
Srinivas et al. Aptamer functionalized Microgel Particles for Protein Detection, Anal Chem. Dec. 1, 2011;83(23):9138-45.
Subramanian et al., Target-specific delivery of doxorubicin to retinoblastoma using epithelial cell adhesion molecule aptamer, Molecular Vision 2012; 18:2783-2795.
Suchanek, M., et al. (2005). Photo-leucine and photo-methionine allow identification of protein-protein interactions. Nat. Methods 2:261-267.
Thery et al., Membrane vesicles as conveyers of immune responses. Nat Rev Immunol. Aug. 2009;9(8):581-93.
Thiel WH et al., Nucleotide bias observed with a short SELEX RNA aptamer library. Nucleic Acid Ther. Aug. 2011;21(4):253-63.
Tombelli et al., Analytical applications of aptamers. Biosens Bioelectron. Jun. 15, 2005;20(12):2424-34.
Traverso et al., Detection of proximal colorectal cancers through analysis of faecal DNA, Lancet 2002; 359:403-404.
Troy et al., Understanding barriers to Borrelia burgdorferi dissemination during infection using massively parallel sequencing. Infect Immun. Jul. 2013;81(7):2347-57.
Tucker et al., Detection and plasma pharmacokinetics of an anti-vascular endothelial growth factor oligonucleotide-aptamer (NX1838) in rhesus monkeys. .J Chromatogr B Biomed Sci Appl. Sep. 10. 1999;732(1):203-12.
Tuerk & Gold, Systematic Evolution of Ligands by Exponential Enrichment: RNA Ligands to Bacteriophage T4 DNA Polymerase, Science 249:505-510, 1990.
Turner et al., Toward Clinical Proteomics on a Next-Generation Sequencing Platform, Anal. Chem. 2011, 83, 666-670.
Ulrich and Wrenger, Disease-specific biomarker discovery by aptamers. Cytometry A. Sep. 2009;75(9):727-33.
Ulrich H et al, DNA and RNA Aptamers: From Tools for Basic Research Towards Therapeutic Applications, Comb Chem High Throughput Screen. Sep. 2006;9(8):619-32.
Ulrich, H et al., In vitro selection of RNA molecules that displace cocaine from the membrane-bound nicotinic acetylcholine receptor, Proc. Natl. Acad. Sci. USA, vol. 95, pp. 14051-14056, Nov. 1998.
Unger M et al., Single-molecule fluorescence observed with mercury lamp illumination. Biotechniques 1999; 27(5):1008-14.
Velculescu et al., Gene Expression Analysis Goes Digital, Nature Biotechnology, 25(8):878-880 (2007).
Voelkerding et al., Next Generation Sequencing for Clinical Diagnostics-Principles and Application to Targeted Resequencing for Hypertrophic Cardiomyopathy, Journal of Molecular Diagnostics, 12(5):539 (2010).
Wang S et al., Delivery of antisense oligodeoxyribonucleotides against the human epidermal growth factor receptor into cultured KB cells with liposomes conjugated to folate via polyethylene glycol, Proc Natl Acad Sci U S A. Apr. 11, 1995;92(8):3318-22.
Wilbur and Lipman, Rapid similarity searches of nucleic acid and protein data banks. Proc Natl Acad Sci USA 80: 726-30 (1983).
Wu, Jie, et al. Identification, Characterization and Application of a G-Quadruplex Structured DNA Aptamer against Cancer Biomarker Protein Anterior Gradient Homolog 2. PLoS One 7.9 (2012): e46393.
Ye et al., Generating aptamers by cell-SELEX for applications in molecular medicine. Int J Mol Sci. 2012;13(3):3341-53.
Zhang et al., Ultrasensitive Detection of Proteins by Amplification of Affinity Aptamers, Angew Chem Int Ed Engl. Feb. 27, 2006;45(10):1576-80.
Zhang Y et al., Aptamers selected by cell-SELEX for application in cancer studies. Bioanalysis. May 2010;2(5):907-18.

* cited by examiner

Screening Scheme

| 5 | x | 20 | = | 100 |
|---|---|----|---|-----|
| Detection Agents | | Capture Agents | | Combinations Screened |

| | |
|---|---|
| CD63 | CD9 | 
| CD9 | PSCA |
| CD81 | TNFR |
| B7H3 | CD63 2X |
| EpCam | B7H3 |
| | Rab IgG |
| | MFG-E8 |
| | EpCam 2X |
| | CD63 |

Rab
IgG
CD81
STEAP
PCSA
PSMA
5T4
CD24
TMEM211

General vesicle biomarkers: CD9, CD63, CD81
Cell of Origin biomarkers: PSCA, MFG-E8, Rab, STEAP, PCSA, PSMA, 5T4, TMEM211
Cancer biomarkers: EpCam, B7H3, CD24
Control biomarkers: Rab IgG, IgG

FIG. 1C

SEQ ID NO. 3840

SEQ ID NO. 1

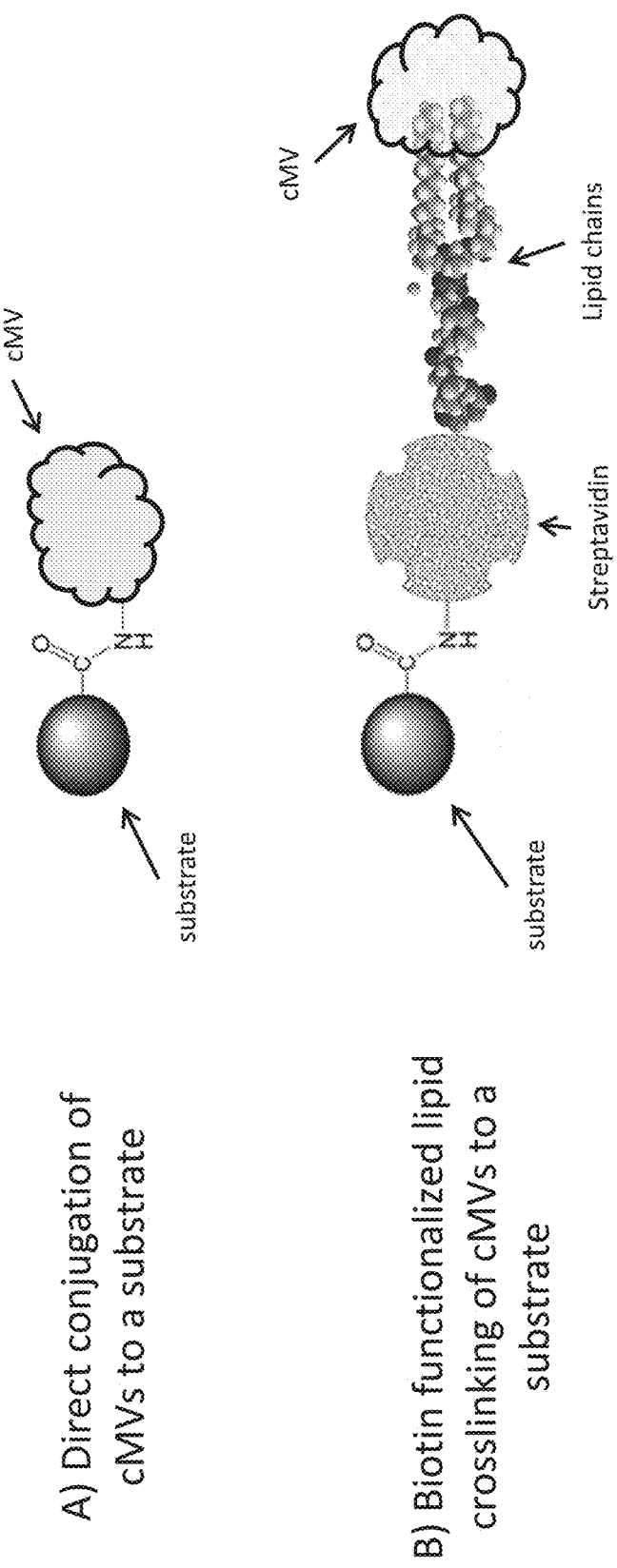
FIGs. 7A-B

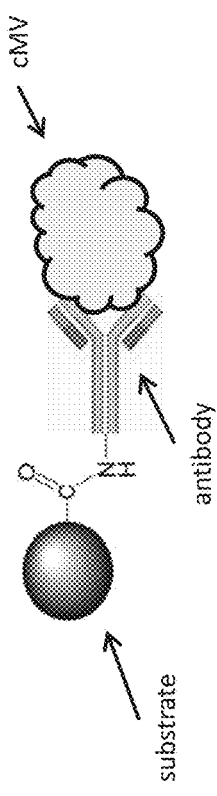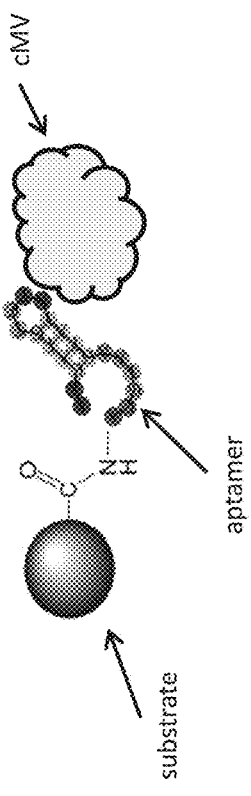
FIGs. 7C-D

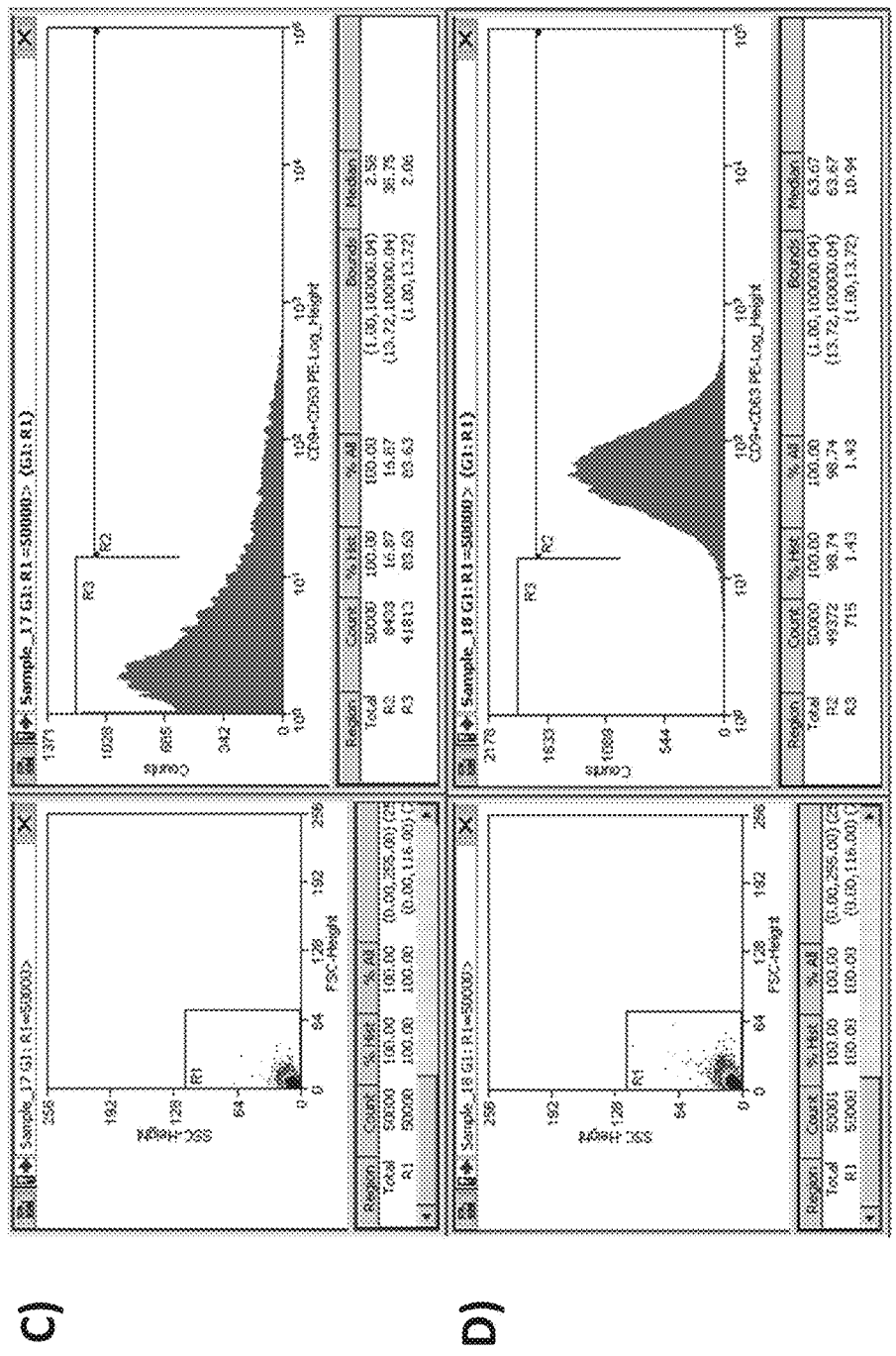
FIGs. 10C-D

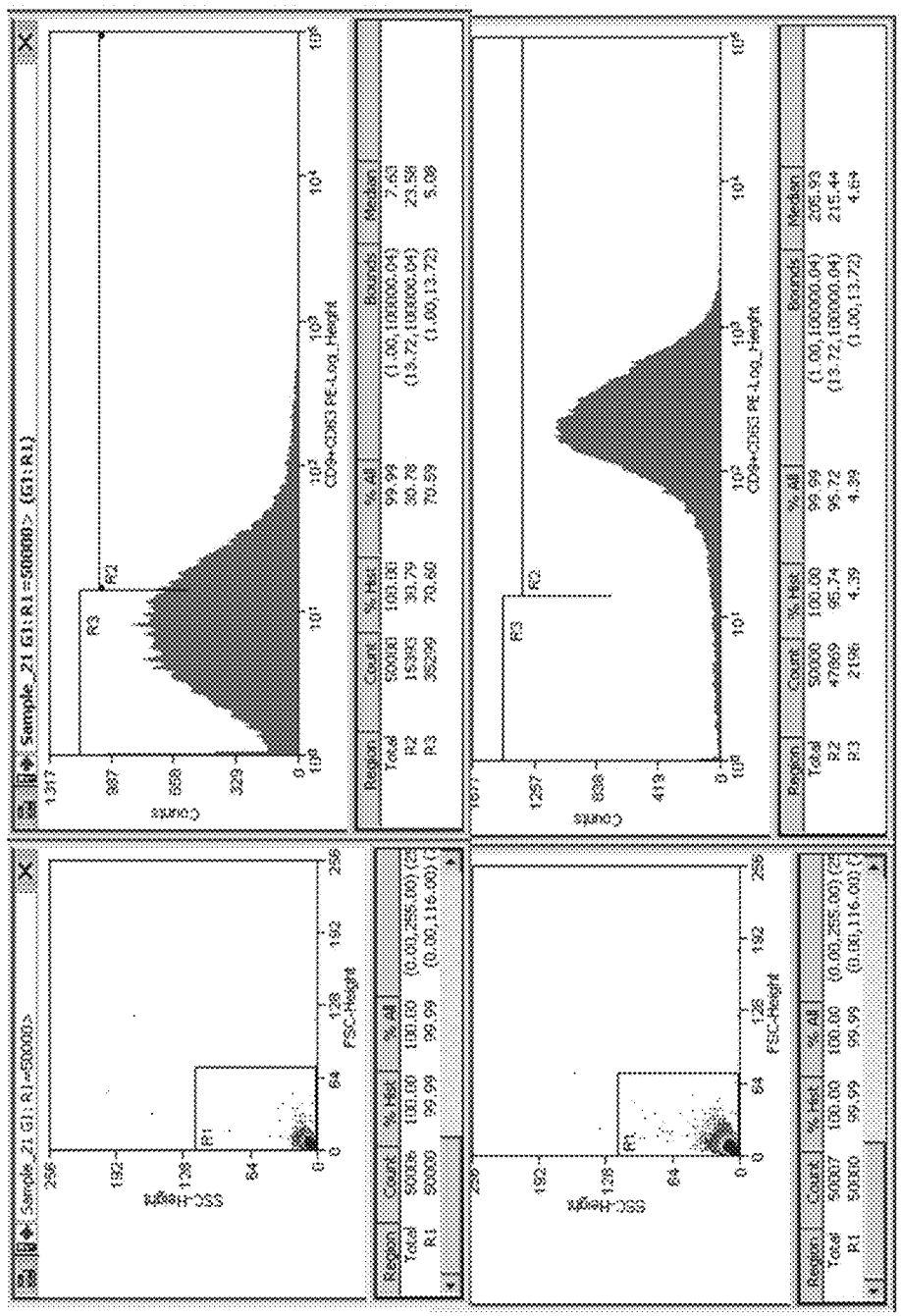
FIGs. 10E-F

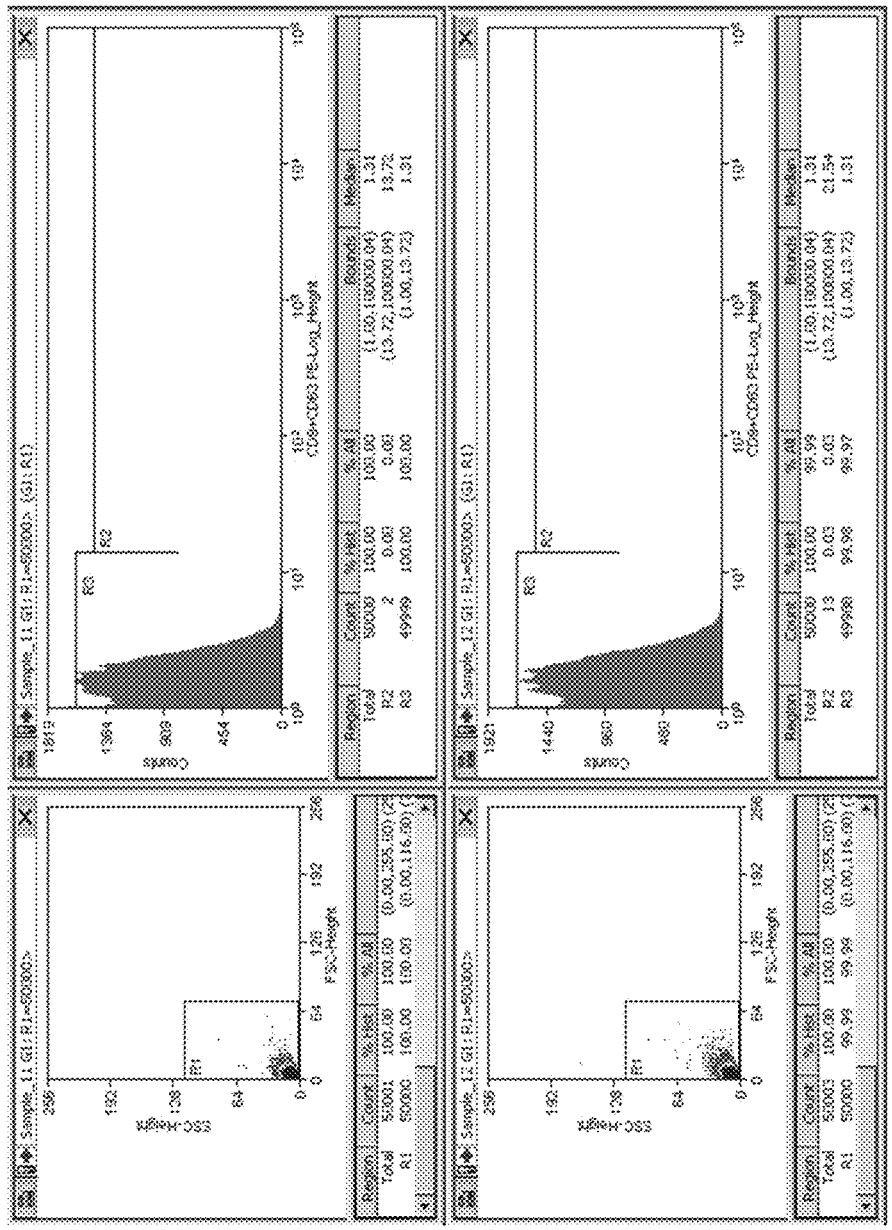
FIGs. 10K-L

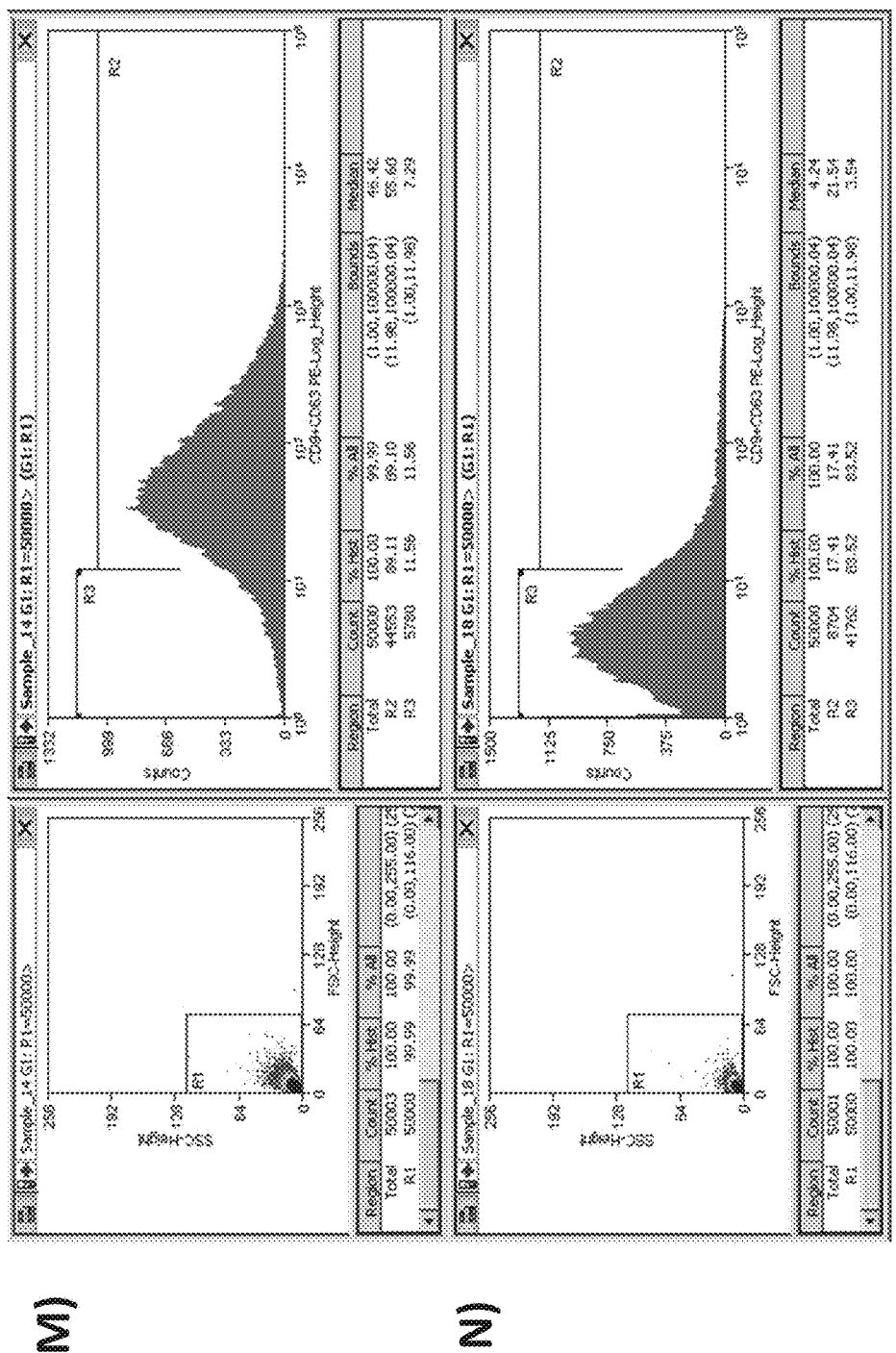
FIGs. 10M-N

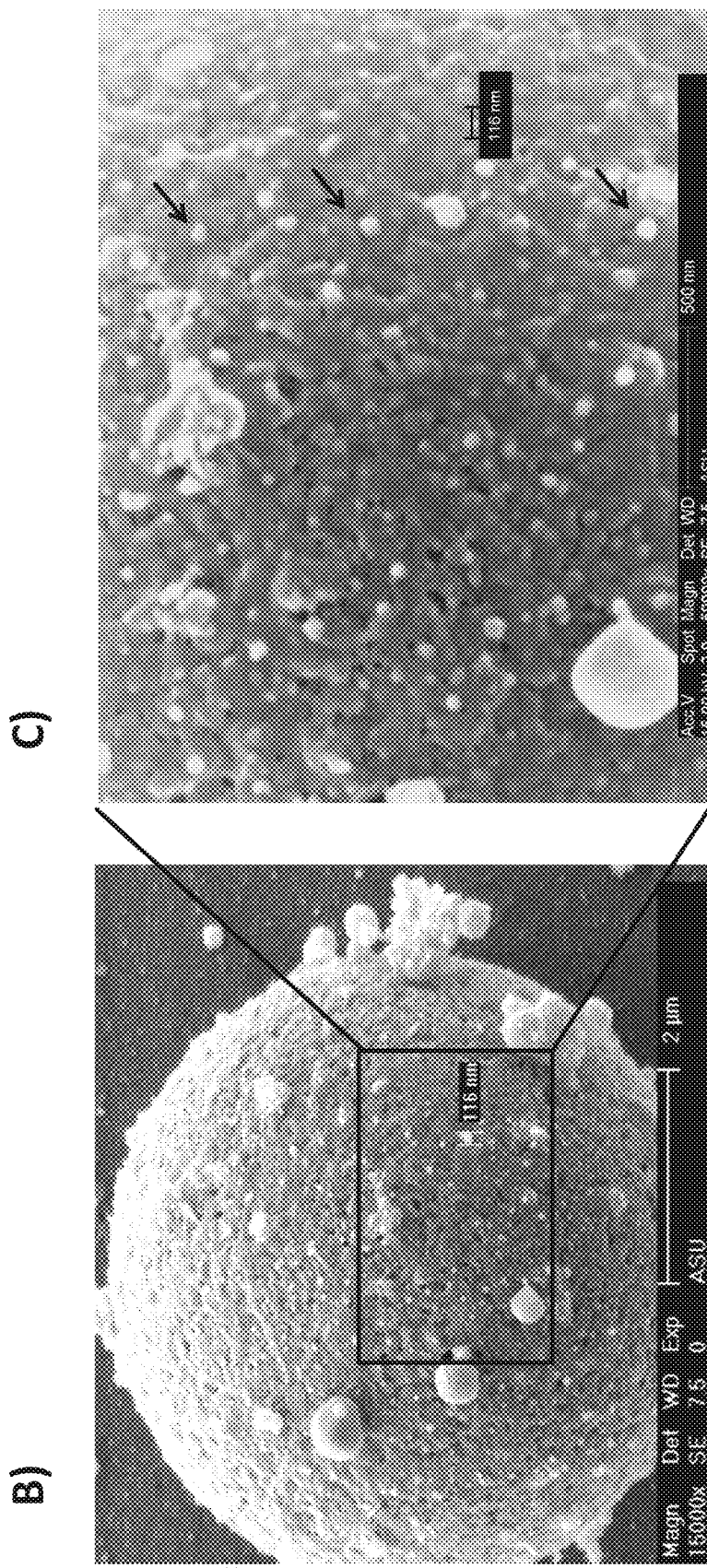
FIGs. 11B-C

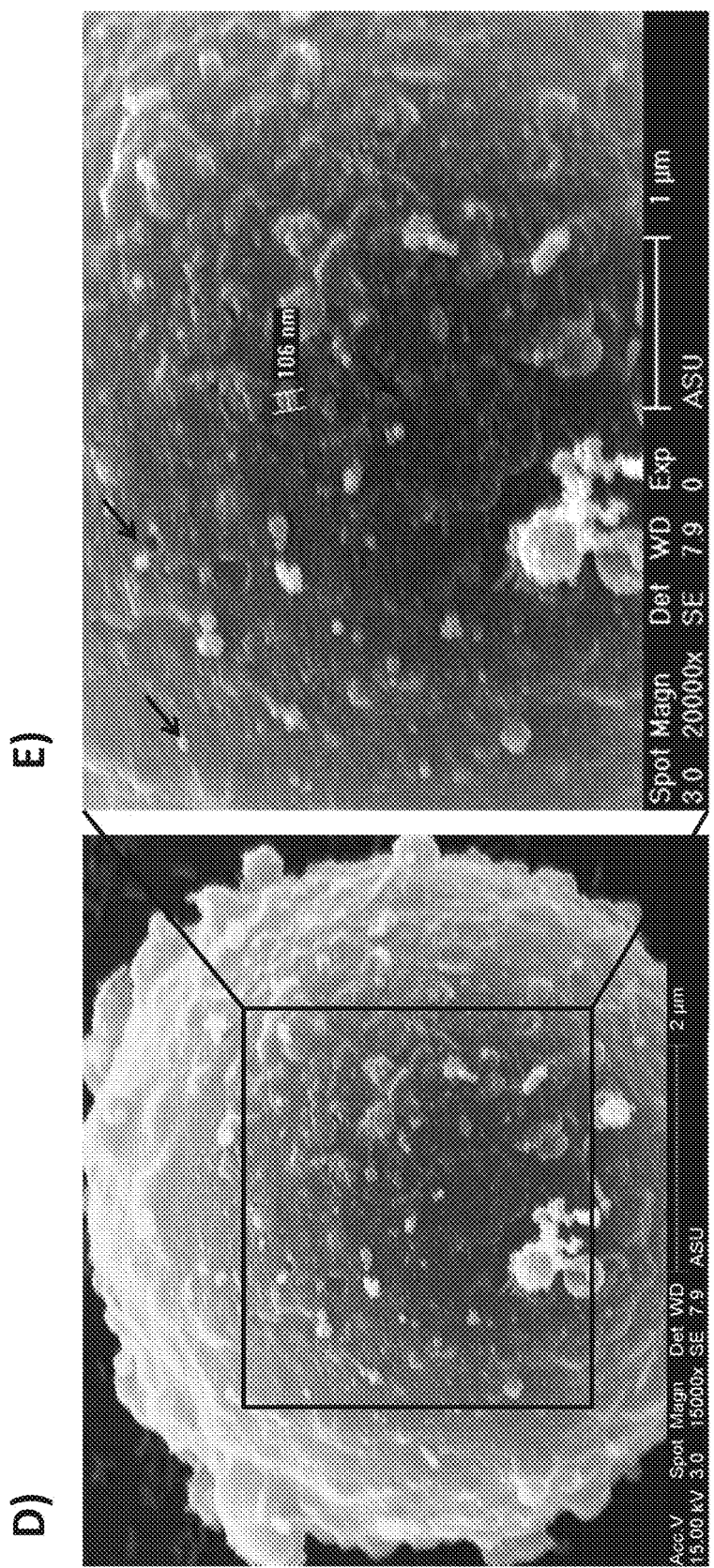
FIGs. 11D-E

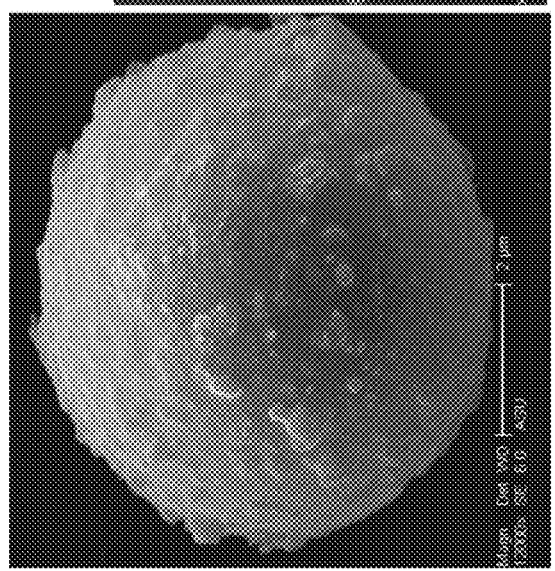
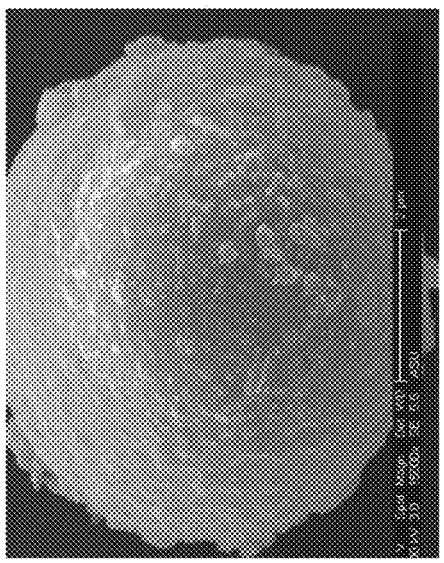
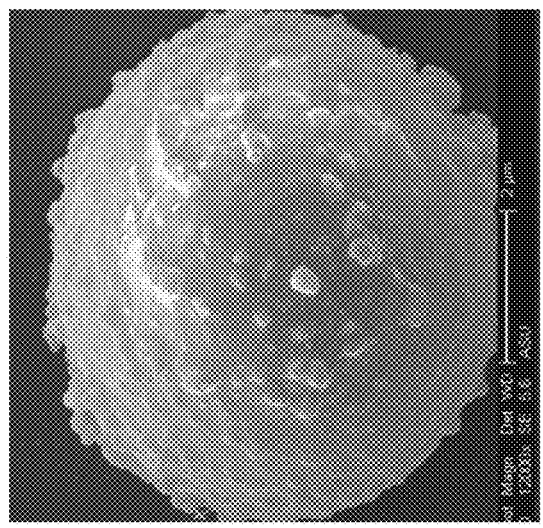
FIGs. 11F-H

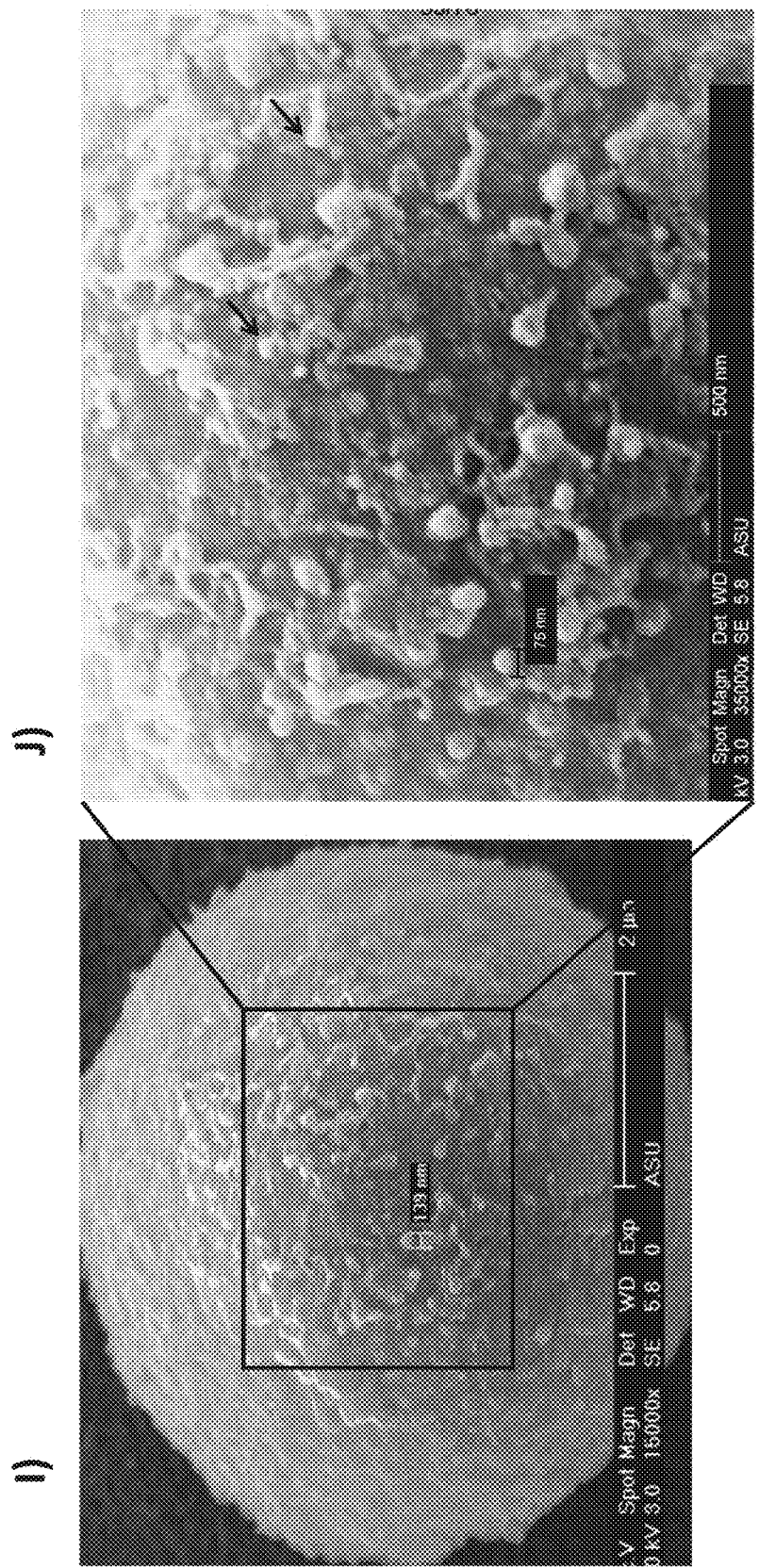
FIGs. 11I-J

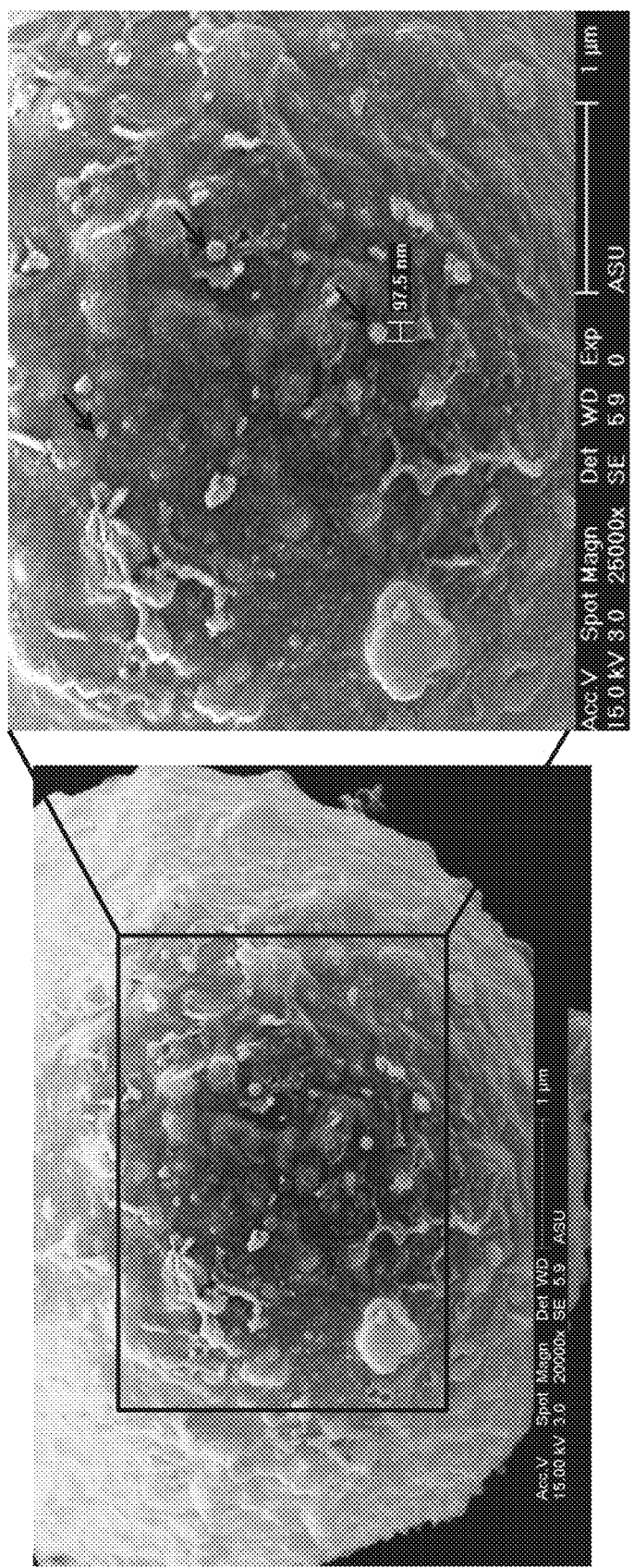
FIGs. 11K-L

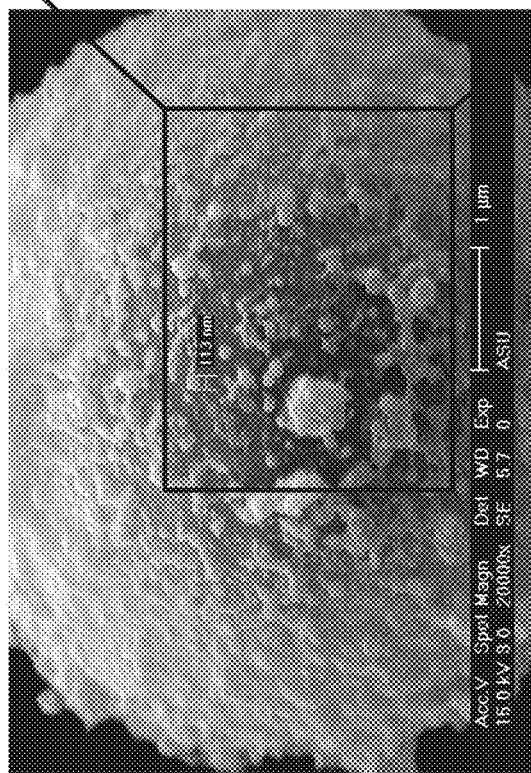
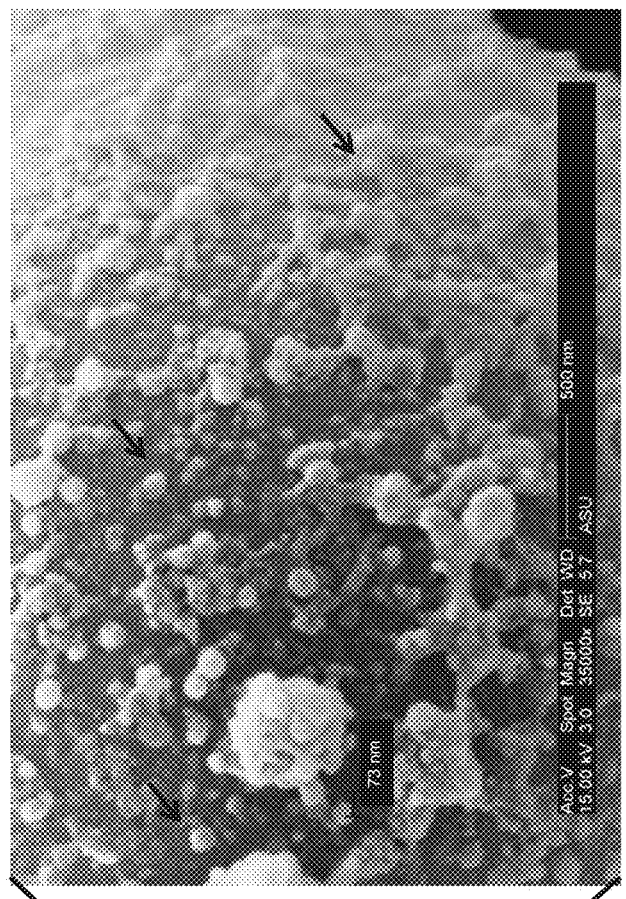
FIGs. 11M-N

| | |
|---|---|
| Selection 1 | Ca1 > nCa1 > Ca2 > nCa2 > Ca3 > nCa3 > Ca4 > nCa4 > Ca5 > nCa5 > Ca6 > nCa6 > Ca7 > nCa7 > Ca8 |
| Selection 2 | Ca8 > nCa1 > Ca7 > nCa2 > Ca6 > nCa3 > Ca5 > nCa4 > Ca4 > nCa5 > Ca3 > nCa6 > Ca2 > nCa7 > Ca1 |
| Selection 3 | Ca8 > nCa7 > Ca7 > nCa6 > Ca6 > nCa5 > Ca5 > nCa4 > Ca4 > nCa3 > Ca3 > nCa2 > Ca2 > nCa1 > Ca1 |
| Selection 4 | Ca2 > nCa7 > Ca3 > nCa6 > Ca4 > nCa5 > Ca5 > nCa4 > Ca6 > nCa3 > Ca7 > nCa2 > Ca8 > nCa1 > Ca1 |
| Selection 5 | Ca7 > nCa2 > Ca5 > nCa4 > Ca3 > nCa6 > Ca1 > nCa1 > Ca7 > nCa7 > Ca8 > nCa3 > Ca6 > nCa5 > Ca4 |
| Selection 6 | Ca4 > nCa3 > Ca5 > nCa2 > Ca6 > nCa1 > Ca7 > nCa8 > Ca8 > nCa6 > Ca1 > nCa5 > Ca2 > nCa4 > Ca3 |
| Selection 7 | Ca5 > nCa1 > Ca3 > nCa3 > Ca1 > nCa2 > Ca8 > nCa4 > Ca6 > nCa3 > Ca4 > nCa5 > Ca2 > nCa7 > Ca7 |

FIG. 13B

A) SEQ ID No. 230822

5'-ATCCAGAGTGACGCGCAGCAGCAGTCTTTTCTGATGGACAC
GTGGTGGTCTAGTATCTGGACACGGTGGCTTAGT

B)

SEQ ID No. 230847

A) CAR016 (SEQ ID NO. 230840)

B) CAR016_M13 (SEQ ID NO. 230883)

D) CAR016_M23 (SEQ ID NO. 230893)

C) CAR016_M14 (SEQ ID NO. 230884)

E) CAR016_M24 (SEQ ID NO. 230894)

F) CAR016_M25 (SEQ ID NO. 230895)

G) CAR016_M26 (SEQ ID NO. 230896)

H) CAR016_M27 (SEQ ID NO. 230897)

j) CAR016_M29 (SEQ ID NO. 230899)

i) CAR016_M28 (SEQ ID NO. 230898)

APTAMERS AND USES THEREOF

CROSS REFERENCE

This application claims the benefit of U.S. Provisional Patent Application Nos. 61/717,566, filed Oct. 23, 2012; 61/731,419, filed Nov. 29, 2012; 61/735,915, filed Dec. 11, 2012; 61/748,437, filed Jan. 2, 2013; 61/749,773, filed Jan. 7, 2013; 61/750,331, filed Jan. 8, 2013; 61/754,471, filed Jan. 18, 2013; 61/767,131, filed Feb. 20, 2013; 61/769,064, filed Feb. 25, 2013; 61/805,365, filed Mar. 26, 2013; 61/808,144, filed Apr. 3, 2013; 61/820,419, filed May 7, 2013; 61/826,957, filed May 23, 2013; 61/838,762, filed Jun. 24, 2013; 61/843,256, filed Jul. 5, 2013; 61/862,809, filed Aug. 6, 2013; 61/863,828, filed Aug. 8, 2013; 61/866,014, filed Aug. 14, 2013; 61/867,978, filed Aug. 20, 2013; 61/871,107, filed Aug. 28, 2013; and 61/874,621, filed Sep. 6, 2013; all of which applications are incorporated herein by reference in their entirety.

SEQUENCE LISTING SUBMITTED VIA EFS-WEB

The entire content of the following electronic submission of the sequence listing via the USPTO EFS-WEB server, as authorized and set forth in MPEP § 1730 II.B.2(a), is incorporated herein by reference in its entirety for all purposes. The sequence listing is within the electronically filed text file that is identified as follows:
File Name: N402774WO_brown_mod_22-JUN-2015_ST25_jt.txt
Date of Creation: Aug. 18, 2015
Size (bytes): 95,427,070 bytes

BACKGROUND OF THE INVENTION

The invention relates generally to the field of aptamers capable of binding to microvesicle surface antigens, which are useful as therapeutics in and diagnostics of cancer and/or other diseases or disorders in which microvesicles implicated. The invention further relates to materials and methods for the administration of aptamers capable of binding to microvesicles. The microvesicles may be derived from cells indicative of cancer.

Aptamers are nucleic acid molecules having specific binding affinity to molecules through interactions other than classic Watson-Crick base pairing.

Aptamers, like peptides generated by phage display or monoclonal antibodies ("mAbs"), are capable of specifically binding to selected targets and modulating the target's activity, e.g., through binding aptamers may block their target's ability to function. Created by an in vitro selection process from pools of random sequence oligonucleotides, aptamers have been generated for over 100 proteins including growth factors, transcription factors, enzymes, immunoglobulins, and receptors. A typical aptamer is 10-15 kDa in size (30-45 nucleotides), binds its target with sub-nanomolar affinity, and discriminates against closely related targets (e.g., aptamers will typically not bind other proteins from the same gene family). A series of structural studies have shown that aptamers are capable of using the same types of binding interactions (e.g., hydrogen bonding, electrostatic complementarity, hydrophobic contacts, steric exclusion) that drive affinity and specificity in antibody-antigen complexes.

Aptamers have a number of desirable characteristics for use as therapeutics and diagnostics including high specificity and affinity, biological efficacy, and excellent pharmacokinetic properties. In addition, they offer specific competitive advantages over antibodies and other protein biologics, for example:

Speed and control. Aptamers are produced by an entirely in vitro process, allowing for the rapid generation of initial leads, including therapeutic leads. In vitro selection allows the specificity and affinity of the aptamer to be tightly controlled and allows the generation of leads, including leads against both toxic and non-immunogenic targets.

Toxicity and Immunogenicity. Aptamers as a class have demonstrated little or no toxicity or immunogenicity. In chronic dosing of rats or woodchucks with high levels of aptamer (10 mg/kg daily for 90 days), no toxicity is observed by any clinical, cellular, or biochemical measure. Whereas the efficacy of many monoclonal antibodies can be severely limited by immune response to antibodies themselves, it is extremely difficult to elicit antibodies to aptamers most likely because aptamers cannot be presented by T-cells via the MHC and the immune response is generally trained not to recognize nucleic acid fragments.

Administration. Whereas most currently approved antibody therapeutics are administered by intravenous infusion (typically over 2-4 hours), aptamers can be administered by subcutaneous injection (aptamer bioavailability via subcutaneous administration is >80% in monkey studies (Tucker et al., J. Chromatography B. 732: 203-212, 1999)). This difference is primarily due to the comparatively low solubility and thus large volumes necessary for most therapeutic mAbs. With good solubility (>150 mg/mL) and comparatively low molecular weight (aptamer: 10-50 kDa; antibody: 150 kDa), a weekly dose of aptamer may be delivered by injection in a volume of less than 0.5 mL. In addition, the small size of aptamers allows them to penetrate into areas of conformational constrictions that do not allow for antibodies or antibody fragments to penetrate, presenting yet another advantage of aptamer-based therapeutics or prophylaxis.

Scalability and cost. Aptamers are chemically synthesized and are readily scaled as needed to meet production demand for diagnostic or therapeutic applications. Whereas difficulties in scaling production are currently limiting the availability of some biologics and the capital cost of a large-scale protein production plant is enormous, a single large-scale oligonucleotide synthesizer can produce upwards of 100 kg/year and requires a relatively modest initial investment. The current cost of goods for aptamer synthesis at the kilogram scale is estimated at $100/g, comparable to that for highly optimized antibodies.

Stability. Aptamers are chemically robust. They are intrinsically adapted to regain activity following exposure to factors such as heat and denaturants and can be stored for extended periods (>1 yr) at room temperature as lyophilized powders.

INCORPORATION BY REFERENCE

All publications, patents and patent applications mentioned in this specification are herein incorporated by reference to the same extent as if each individual publication, patent or patent application was specifically and individually indicated to be incorporated by reference.

SUMMARY OF THE INVENTION

Compositions and methods of the invention provide aptamers that bind biomarkers of interest such as microvesicle surface antigens or functional fragments of microvesicle surface antigens. In various embodiments, aptamers of the invention are used in diagnostic, prognostic, or theranostic processes to screen a biological sample for the presence or levels of microvesicle surface antigens determined to provide a diagnostic, prognostic, or theranostic readout. The diagnosis, prognosis, or theranosis may be related to cancer. The invention also provides methods and composition to facilitate aptamer library screening and aptamer detection methods.

In an aspect, the invention provides an aptamer that binds to a microvesicle, comprising a nucleic acid sequence that is at least 50, 55, 60, 65, 70, 75, 80, 85, 90, 95, 96, 97, 98, 99 or 100 percent homologous of any of: a) SEQ ID NOs. 230900-230903, 230908, 230913-230927 or a variable sequence of any preceding sequence as described in Table 18; or b) a functional fragment of any preceding sequence. The aptamer may comprise any of SEQ ID NOs. 230900-230903, 230908, 230913-230927, or a functional fragment thereof. The functional fragment may comprise any fragment that retains ability to bind the aptamer target, including without limitation a "Variable Sequence" region as indicated in Table 18. In some embodiments, the microvesicle is shed from a prostate-cancer cell.

In another aspect, the invention provides an aptamer that binds to a microvesicle, comprising a nucleic acid sequence that is at least 50, 55, 60, 65, 70, 75, 80, 85, 90, 95, 96, 97, 98, 99 or 100 percent homologous of any of: a) SEQ ID NOs. 231018-231031 or a variable sequence thereof as described in Table 23; b) SEQ ID NOs. 231032-231051 or a variable sequence thereof as described in Table 24; c) SEQ ID NOs. 231032-241535; or d) a functional fragment of any preceding sequence. The aptamer may comprise any of SEQ ID NOs. 231018-231031, or a functional fragment thereof. The aptamer may also comprise any of SEQ ID NOs. 231032-231051, or a functional fragment thereof. The functional fragment may comprise any fragment that retains ability to bind the aptamer target, including without limitation a "Variable Sequence" region as indicated in any of Tables 23-24. In some embodiments, the microvesicle is shed from a breast-cancer cell.

In still another aspect, the invention provides an aptamer that binds to an epithelial cell adhesion molecule (EpCAM) protein, comprising a nucleic acid sequence that is at least 50, 55, 60, 65, 70, 75, 80, 85, 90, 95, 96, 97, 98, 99 or 100 percent homologous of any of: a) SEQ ID NOs. 1-230810; b) SEQ ID NOs. 230822-230899, 230904-230907, 230909-230911 or a variable sequence of any thereof as described in Tables 11, 12, 13, 15; or c) a functional fragment of any preceding sequence. The aptamer may comprise any of Aptamer4 (SEQ ID NO. 1), Oligo6 (SEQ ID NO. 230810), Oligo4B (SEQ ID NO. 183132), CAR003 (SEQ ID NO. 230822 or SEQ ID NO. 230823), CAR016 (SEQ ID NO. 230840), or a functional fragment thereof. The aptamer can be from any of Tables 5, 6, 7, 8, 11, 12, 13, 15, 16, or a functional fragment thereof. The functional fragment may comprise any fragment that retains ability to bind the aptamer target, including without limitation a "Variable Sequence" region as indicated in any of Tables 11, 12, 13, 15, or a functional fragment thereof. In some embodiments, the aptamer has the ability to modulate EpCAM signal transduction in vitro. Further, the aptamer may have the ability to modulate EpCAM signal transduction in vivo.

In yet another aspect, the invention provides an aptamer that binds to a prostate specific membrane antigen (PSMA) protein, comprising a nucleic acid sequence that is at least 50, 55, 60, 65, 70, 75, 80, 85, 90, 95, 96, 97, 98, 99 or 100 percent homologous of any of: a) SEQ ID NOs. 230932-230935 or a variable sequence thereof as described in Table 20; or b) a functional fragment of any preceding sequence.

The aptamers of the invention may be identified herein in the form of DNA or RNA. Unless otherwise specified, one of skill in the art will appreciate that an aptamer may generally be synthesized in various forms of nucleic acid. The aptamers may also carry various chemical modifications and remain within the scope of the invention.

In some embodiments, an aptamer of the invention is modified to comprise at least one chemical modification. The modification may include without limitation a chemical substitution at a sugar position; a chemical substitution at a phosphate position; and a chemical substitution at a base position of the nucleic acid. In some embodiments, the modification is selected from the group consisting of: biotinylation, incorporation of a fluorescent label, incorporation of a modified nucleotide, a 2'-modified pyrimidine, 3' capping, conjugation to an amine linker, conjugation to a high molecular weight, non-immunogenic compound, conjugation to a lipophilic compound, conjugation to a drug, conjugation to a cytotoxic moiety, and labeling with a radioisotope, or other modification as disclosed herein. The position of the modification can be varied as desired. For example, the biotinylation, fluorescent label, or cytotoxic moiety can be conjugated to the 5' end of the aptamer. The biotinylation, fluorescent label, or cytotoxic moiety can also be conjugated to the 3' end of the aptamer.

In some embodiments, the cytotoxic moiety is encapsulated in a nanoparticle. The nanoparticle can be selected from the group consisting of: liposomes, dendrimers, and comb polymers. In other embodiments, the cytotoxic moiety comprises a small molecule cytotoxic moiety. The small molecule cytotoxic moiety can include without limtation vinblastine hydrazide, calicheamicin, *vinca* alkaloid, a cryptophycin, a tubulysin, dolastatin-10, dolastatin-15, auristatin E, rhizoxin, epothilone B, epithilone D, taxoids, maytansinoids and any variants and derivatives thereof. In still other embodiments, the cytotoxic moiety comprises a protein toxin. For example, the protein toxin can be selected from the group consisting of diphtheria toxin, ricin, abrin, gelonin, and *Pseudomonas* exotoxin A. Non-immunogenic, high molecular weight compounds for use with the invention include polyalkylene glycols, e.g., polyethylene glycol. Appropriate radioisotopes include yttrium-90, indium-111, iodine-131, lutetium-177, copper-67, rhenium-186, rhenium-188, bismuth-212, bismuth-213, astatine-211, and actinium-225. The aptamer may be labeled with a gamma-emitting radioisotope.

In some embodiments of the invention, an active agent is conjugated to the aptamer. For example, the active agent may be a therapeutic agent or a diagnostic agent. The therapeutic agent may be selected from the group consisting of tyrosine kinase inhibitors, kinase inhibitors, biologically active agents, biological molecules, radionuclides, adriamycin, ansamycin antibiotics, asparaginase, bleomycin, busulphan, cisplatin, carboplatin, carmustine, capecotabine, chlorambucil, cytarabine, cyclophosphamide, camptothecin, dacarbazine, dactinomycin, daunorubicin, dexrazoxane, docetaxel, doxorubicin, etoposide, epothilones, floxuridine, fludarabine, fluorouracil, gemcitabine, hydroxyurea, idarubicin, ifosfamide, irinotecan, lomustine, mechlorethamine, mercaptopurine, melphalan, methotrexate, rapamycin (sirolimus), mitomycin, mitotane, mitoxantrone, nitrosurea, paclitaxel, pamidronate, pentostatin, plicamycin, procarbazine, rituximab, streptozocin, teniposide, thioguanine, thiotepa, taxanes, vinblastine, vincristine, vinorelbine, taxol, combretastatins, discodermolides, transplatinum, anti-vascular endothelial growth factor compounds ("anti-VEGFs"), anti-epidermal growth factor receptor compounds ("anti-EGFRs"), 5-fluorouracil and derivatives, radionuclides, polypeptide toxins, apoptosis inducers, therapy sensitizers, enzyme or active fragment thereof, and combinations thereof.

The invention further provides a pharmaceutical composition comprising a therapeutically effective amount of the aptamer described above or a salt thereof, and a pharmaceutically acceptable carrier or diluent. The invention also provides a pharmaceutical composition comprising a therapeutically effective amount of the aptamer or a salt thereof, and a pharmaceutically acceptable carrier or diluent. Relatedly, the invention provides a method of treating or ameliorating a disease or disorder, comprising administering the pharmaceutical composition to a subject in need thereof. Administering a therapeutically effective amount of the composition to the subject may result in: (a) an enhancement of the delivery of the active agent to a disease site relative to delivery of the active agent alone; or (b) an enhancement of microvesicles clearance resulting in a decrease of at least 10%, 20%, 30%, 40%, 50%, 60%, 70%, 80%, or 90% in a blood level of microvesicles targeted by the aptamer; or (c) an decrease in biological activity of microvesicles targeted by the aptamer of at least 10%, 20%, 30%, 40%, 50%, 60%, 70%, 80%, or 90%. In an embodiment, the biological activity of microvesicles comprises immune suppression or transfer of genetic information. The disease or disorder can include without limitation those disclosed herein. For example, the disease or disorder may comprise a neoplastic, proliferative, or inflammatory, metabolic, cardiovascular, or neurological disease or disorder. See section "Phenotypes."

The invention further provides a kit comprising an aptamer disclosed herein, or a pharmaceutical composition thereof.

In an aspect, the invention provides a method comprising contacting the aptamer as described above with a biological sample and detecting the presence or absence of binding of the aptamer to a microvesicle in the biological sample. As disclosed herein, the biological sample can be a tissue, fluid or cell culture sample. For example, the biological sample may comprise blood or a blood component. In some embodiments, the aptamer is conjugated to a substrate prior to the contacting with the biological sample. For example, the substrate may comprise a bead or a plate well. The aptamer may also be conjugated to a detectable label. Various configurations of the method are provided herein. See, e.g., FIGS. 1A-1B.

In a related aspect, the invention provides a method of detecting a presence or level of a microvesicle population in a biological sample suspected of containing the microvesicle population, comprising contacting the biological sample with one or more binding agent specific to the microvesicle population and one or more aptamer as described above, and detecting microvesicles that are recognized by both the one or more binding agent and the one or more aptamer, thereby detecting the presence or level of the microvesicle population in the biological sample.

The biological sample can be a tissue sample, a cell culture, or a bodily fluid. The bodily fluid can be any useful fluid, including without limitation one or more of peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. In some embodiments, the bodily fluid comprises blood, serum or plasma.

Any useful binding agent can be used in the subject methods. In some embodiments, the one or more binding agent comprises an antibody or aptamer to a microvesicle surface antigen selected from Table 3, Table 4, and a combination thereof. The one or more binding agent can also be an antibody or aptamer to a microvesicle surface antigen selected from a target in Table 26. For example, the one or more binding agent may be an antibody or aptamer to a microvesicle surface antigen selected from the group consisting of EpCam, CD9, PCSA, CD63, CD81, PSMA, B7H3, PSCA, ICAM, STEAP, KLK2, SSX2, SSX4, PBP, SPDEF, EGFR, and a combination thereof. The one or more binding agent can also comprise an antibody or aptamer to a microvesicle surface antigen selected from the group consisting of EGFR, PBP, EpCAM, KLK2, and a combination thereof.

The invention contemplates various configurations. For example, a "sandwich" format can be used. See, e.g., FIGS. 1A-1B. In some embodiments of the method, the one or more binding agent is conjugated to a substrate prior to the contacting with the biological sample. In this configuration, the one or more aptamer may be conjugated to a detectable label to serve as a detector agent. In other embodiments, the one or more binding agent is conjugated to a detectable label. In this configuration, the one or more aptamer may be conjugated to a substrate prior to the contacting with the biological sample to serve as a capture agent. Furthermore, the one or more aptamer can be conjugated to a substrate prior to the contacting with the biological sample, and/or the one or more aptamer is conjugated to a detectable label. In such cases, the one or more aptamer can act as either or both of a capture agent and a detection agent.

The method of detecting a presence or level of a microvesicle population in a biological sample can be used to provide a diagnosis, prognosis or theranosis of a disease or disorder. The disease or disorder can include without limitation those disclosed herein. For example, the disease or disorder may comprise a neoplastic, proliferative, or inflammatory, metabolic, cardiovascular, or neurological disease or disorder. See section "Phenotypes." In an embodiment, the disease comprises a cancer. For example, the disease can be an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sezary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenstrim macroglobulinemia; or Wilm's tumor. The cancer can be a prostate cancer. The cancer can be a breast cancer.

In another related aspect, the invention provides a method of characterizing a disease or disorder, comprising: (a) contacting a biological test sample with one or more aptamer as provided herein; (b) detecting a presence or level of a complex between the one or more aptamer and the target bound by the one or more aptamer in the biological test sample formed in step (a); and (c) comparing the presence or level detected in step (b) to a reference level from a biological control sample, thereby characterizing the disease or disorder. The reference level may be derived from a level of the target in a healthy sample individual, e.g., one that does not have or is not known to have the disease or disorder. The reference level may also be derived from an individual or sample having a treated, controlled, or alternate disease.

The biological test sample and biological control sample may each comprise a tissue sample, a cell culture, or a biological fluid. In some embodiments, the biological fluid comprises a bodily fluid. The bodily fluid can be any useful fluid, including without limitation one or more of peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In some embodiments, the bodily fluid comprises blood, serum or plasma. The biological fluid may comprise or be suspected to comprise microvesicles.

The one or more aptamer may bind a polypeptide or fragment thereof. The binding may be promiscuous or selective as desired. The polypeptide or fragment thereof can be soluble or membrane bound, e.g., in the membrane of a microvesicle or cell fragment. The polypeptide or fragment thereof comprises a biomarker in Table 3, Table 4, or Table 26. The one or more aptamer can bind a microvesicle surface antigen in the biological sample.

The method herein of characterizing a disease or disorder may include providing a diagnosis, prognosis or theranosis of the disease or disorder. The disease or disorder can include without limitation those disclosed herein. For example, the disease or disorder may comprise a cancer, a premalignant condition, an inflammatory disease, an immune disease, an autoimmune disease or disorder, a cardiovascular disease or disorder, a neurological disease or disorder, an infectious disease, and/or pain. See section "Phenotypes" herein. In some embodiments, the disease or disorder comprises a cancer. The cancer comprises an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/ plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sezary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenstrim macroglobulinemia; or Wilm's tumor. The cancer can be a prostate cancer. The cancer can be a breast cancer.

The invention further provides a kit comprising a reagent for carrying out the methods herein and also use of the reagent for carrying out the methods. The reagent may comprise an aptamer disclosed herein and/or other components as disclosed herein.

The invention provides compositions and methods for use of an aptamer pool comprising a plurality of oligonucleotides for detecting biomarkers of interest. Such compositions and methods may facilitate characterization of a phenotype in a biological sample. In one aspect, the invention provides a composition of matter comprising a plurality of oligonucleotides selected from SEQ ID NOs. 1-230810, 230811-230899, 230900-230927 or 231018-241535, which oligonucleotides are capable of binding to a plurality of targets present in a biological sample. The composition of matter may also comprise an oligonucleotide selected from SEQ ID NOs. 1-230810, 230811-230899, 230900-230927 or 231018-241535. In an embodiment, the compositions comprise at least 2, 3, 4, 5, 6, 7, 8, 9, 10, 11, 12, 13, 14, 15, 16, 17, 18, 19, 20, 25, 30, 40, 50, 60, 70, 80, 90, 100, 200, 300, 400, 500, 600, 700, 800, 900, 1000, 2000, 3000, 4000, 5000, 6000, 7000, 8000, 9000, 10000 or all oligonucleotides listed in SEQ ID NOs. 231018-241535. In another embodiment, the compositions comprise at least 2, 3, 4, 5, 6, 7, 8, 9, 10, 11, 12, 13, 14, 15, 16, 17, 18, 19, 20, 25, 30, 40, 50, 60, 70, 80, 90, 100, 200, 300, 400, 500, 600, 700, 800, 900, 1000, 2000, 3000, 4000, 5000, 6000, 7000, 8000, 9000, 10000 or all oligonucleotides listed in SEQ ID NOs. 1-230810. The invention also provides a composition of matter comprising one or more oligonucleotides set forth in any of Tables 23-24 capable of binding to a plurality of targets present in a biological sample. The composition of matter may comprise one or more oligonucleotide listed in any of Tables 23-24. In some embodiments, the composition comprises 1, 2, 3, 4, 5, 6, 7, 8, 9, 10, 11, 12, 13, 14, 15, 16, 17, 18, 19 or 20 oligonucleotides listed in Table 23 or Table 24.

In a related aspect, the invention provides a method for characterizing a condition for a test sample comprising: contacting a microvesicle sample with a plurality of oligonucleotides capable of binding one or more target(s) present in said microvesicle sample, identifying a set of oligonucleotides that form a complex with the sample wherein the set is predetermined to characterize a condition for the sample, thereby characterizing a condition for a sample. Identifying oligonucleotides may comprise performing sequencing of all or some of the oligonucleotides. Identifying can also comprise performing amplification of all or some of the oligonucleotides, e.g. via PCR methodology and variants thereof (RT-PCR, qPCR, etc). Identifying can also comprise performing hybridization of all or some of the oligonucleotides to an array. The condition can be a disease or disorder. For example, the condition can be a cancer, a premalignant condition, an inflammatory disease, an immune disease, an autoimmune disease or disorder, a cardiovascular disease or disorder, a neurological disease or disorder, an infectious disease, and/or pain. See section "Phenotypes" herein.

In another related aspect, the invention provides a method for identifying a set of oligonucleotides associated with a test sample, comprising: (a) contacting a microvesicle sample with a plurality of oligonucleotides, isolating a set of oligonucleotides that form a complex with the microvesicle sample, (b) determining a sequence and/or a copy number for each of the oligonucleotides that formed a complex with the microvesicle sample in (a), thereby identifying a set of oligonucleotides associated with the test sample. Step (b) can include performing high-throughput sequencing. Step (b) can also include performing hybridization to an array or amplification. In an embodiment, the sample is from a subject suspected of having or being predisposed to having a cancer. In some embodiments, the plurality of oligonucleotides is capable of preferentially binding a microvesicle that is shed from diseased cells versus normal cells. The diseased cells can be associated with a cancer, a premalignant condition, an inflammatory disease, an immune disease, an autoimmune disease or disorder, a cardiovascular disease or disorder, neurological disease or disorder, infectious disease or pain.

In still another related aspect, the invention provides a method of diagnosing a sample as cancerous or predisposed to be cancerous, comprising contacting a microvesicle sample with a plurality of oligonucleotides that are predetermined to preferentially form a complex with microvesicles from a cancer sample as compared to microvesicles from a non-cancer sample.

In some embodiments, the plurality of oligonucleotides are pre-selected through a one or more steps of positive or negative selection, wherein positive selection comprises selection of oligonucleotides against a sample having substantially similar characteristics compared to the test sample, and wherein negative selection comprises selection of oligonucleotides against a sample having substantially different characteristics compared to the test sample.

In yet another related aspect, the invention provides a method of characterizing a disease or disorder, comprising: (a) contacting a biological test sample with an aptamer pool; (b) detecting a presence or level of a complex formed in step (a) between the members of the aptamer pool and biological test sample; and (c) comparing the presence or level detected in step (b) to a reference level, thereby characterizing the disease or disorder. The reference level may be derived from a level of the target in a healthy sample individual, e.g., one that does not have or is not known to have the disease or disorder. The reference level may also be derived from an individual or sample having a treated, controlled, or alternate disease. The biological test sample may comprise a tissue sample, a cell culture, or a biological fluid. In some embodiments, the biological fluid comprises a bodily fluid. The bodily fluid can be any useful fluid, including without limitation one or more of peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In some embodiments, the bodily fluid comprises blood, serum or plasma. The biological fluid may comprise or be suspected to comprise microvesicles. In such cases, the aptamer pool can be chosen to bind to microvesicles. The microvesicles can be isolated before contact with the aptamer pool, or the test sample can be directly contacted with the aptamer pool before isolating microvesicles.

As noted, the compositions and methods for use of an aptamer pool comprising a plurality of oligonucleotides can be used to detect, diagnose, prognose or theranose various diseases and disorders, including without limitation a cancer, a premalignant condition, an inflammatory disease, an immune disease, an autoimmune disease or disorder, a cardiovascular disease or disorder, neurological disease or disorder, infectious disease or pain. In embodiments, the cancer comprises an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin cancer; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sezary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenstrm macroglobulinemia; or Wilm's tumor. The premalignant condition may be Barrett's Esophagus. In some embodiments, the autoimmune disease comprises inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. In other embodiments, the cardiovascular disease comprises atherosclerosis, congestive heart failure, vulnerable plaque, stroke, ischemia, high blood pressure, stenosis, vessel occlusion or a thrombotic event. The neurological disease may include without limitation Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain may include fibromyalgia, chronic neuropathic pain, or peripheral neuropathic pain. In embodiments, the infectious disease comprises a bacterial infection, viral infection, yeast infection, Whipple's Disease, Prion Disease, cirrhosis, methicillin-resistant *staphylococcus aureus*, HIV, HCV, hepatitis, syphilis, meningitis, malaria, tuberculosis, influenza.

In the methods for use of an aptamer pool comprising a plurality of oligonucleotides, the plurality of oliognucleotides can be a composition as provided herein.

In another related aspect, the invention provides a method of performing high-throughput sequencing comprising: (a) performing at least one (i) negative selection or (ii) one positive selection of a plurality of oligonucleotides with a microvesicle sample; (b) obtaining a set of oliognucleotides to provide a negative binder subset or positive binder subset of the plurality of oligonucleotides, wherein the negative binder subset of the plurality of oligonucleotides does not bind the microvesicle sample and wherein the positive binder subset of the plurality of oligonucleotides does bind the microvesicle sample; (c) contacting the negative binder subset or positive binder subset with a test sample; (d) eluting oligonucleotides that bound to the test sample to provide a plurality of eluate oligonucleotides; and (e) performing high-throughput sequencing of the plurality of eluate oligonucleotides to identify sequence and/or copy number of the members of the plurality of eluate oligonucleotides.

In another related aspect, the invention provides a method for identifying oligonucleotides specific for a test sample comprising: (a) enriching a plurality of oligonucleotides for a sample to provide a set of oligonucleotides predetermined to form a complex with a target sample; (b) contacting the plurality in (a) with a test sample to allow formation of complexes of oligonucleotides with test sample; (c) recovering oligonucleotides that formed complexes in (b) to provide a recovered subset of oligonucleotides; and (d) profiling the recovered subset of oligonucleotides by high-throughput sequencing, amplification or hybridization, thereby identifying oligonucleotides specific for a test sample. The test sample can include a plurality of microvesicles. The oligonucleotides can be RNA, DNA or both. The method may further comprise performing informatics analysis to identify a subset of oligonucleotides comprising sequence identity of at least 90%.

The invention further provides a kit comprising a reagent for carrying out the methods of use of an aptamer pool and also use of the reagent for carrying out such methods. The reagent may comprise a related aptamer or composition disclosed herein and/or other components as disclosed herein.

The invention also provides methods of identifying the pool of aptamers. In one aspect, such a method of identifying a target-specific aptamer profile for a biological sample comprises contacting a biological test sample with a pool of aptamer molecules, contacting the pool to a control or reference biological sample, identifying one or more aptamers that bind to a component in said test sample but not to the control or reference sample, thereby identifying an aptamer profile for said biological test sample.

In another related aspect, the invention provides a method of selecting a pool of aptamers, comprising: (a) contacting a biological control sample with a pool of oligonucleotides; (b) isolating a first subset of the pool of oligonucleotides that do not bind the biological control sample; (c) contacting the biological test sample with the first subset of the pool of oligonucleotides; and (d) isolating a second subset of the pool of oligonucleotides that bind the biological test sample, thereby selecting the pool of aptamers. The starting pool of oligonucleotides may comprise a large number of sequences, e.g., at least $10^7$, $10^8$, $10^9$, $10^{10}$, $10^{11}$, $10^{12}$, $10^{13}$, $10^{14}$, $10^{15}$, $10^{16}$ $10^{17}$, or at least $10^{18}$ oligonucleotides. Steps (a)-(d) can be repeated at least 1, 2, 3, 4, 5, 6, 7, 8, 9, 10, 11, 12, 13, 14, 15, 16, 17, 18, 19 or at least 20 times, wherein the pool of aptamers selected in step (d) is used as the pool of oligonucleotides in step (a) in each iteration.

In some embodiments, the biological test sample and biological control sample comprise microvesicles. The biological test sample and optionally biological control sample can be any useful biological sample as disclosed herein. For example, they may comprise a bodily fluid. The bodily fluid may include without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, Cowper's fluid, pre-ejaculatory fluid, female ejaculate, sweat, fecal matter, hair, tears, cyst fluid, pleural fluid, peritoneal fluid, malignant fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids. The biological test sample and optionally biological control sample may also comprise a tissue sample or cell culture. The biological test sample can be a diseased sample and the biological control sample can be a non-diseased sample. Such configuration can allow identification of pools of aptamers that preferentially recognize a diseased sample, or preferentially recognize a non-diseased sample.

In still another related aspect, the invention provides a method of selecting a group of aptamers, comprising: (a) contacting a pool of aptamers to a population of microvesicles from a first sample; (b) enriching a subpool of aptamers that show affinity to the population of microvesicles from the first sample; (c) contacting the subpool to a second population of microvesicles from a second sample; and (d) depleting a second subpool of aptamers that show affinity to the second population of microvesicles from the second sample, thereby selecting the group of aptamers that have preferential affinity for the the population of microvesicles from the first sample.

The first sample and/or second sample can be any useful can be any useful biological sample as disclosed herein. For example, they may comprise a bodily fluid. The bodily fluid may include without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, Cowper's fluid, pre-ejaculatory fluid, female ejaculate, sweat, fecal matter, hair, tears, cyst fluid, pleural fluid, peritoneal fluid, malignant fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids. The first sample and/or and the second sample may each comprise a pooled sample, i.e., a sample pooled together from various sources such as different individuals. The first sample may be a diseased sample while the second sample comprises a control sample, optionally wherein the control sample is a non-disease sample. Alternately, the first sample may be a control sample while the second sample comprises a disease sample, optionally wherein the control sample is a non-disease sample.

Steps (a)-(d) may be repeated at least 1, 2, 3, 4, 5, 6, 7, 8, 9, 10, 11, 12, 13, 14, 15, 16, 17, 18, 19 or 20 times, wherein the group of aptamers selected in step (d) is used as the pool of aptamers in step (a) in each iteration. In embodiments, the first sample and/or second sample are replaced with a different sample before repeating steps (a)-(d). For example, the first sample and/or second sample can be from a different individual or comprise a different sample pool.

The method may further comprise identifying the members of the selected group of aptamers, optionally wherein the identifying is performed by high-throughput sequencing, amplification or hybridization.

In an aspect, the invention provides a method of selecting a group of aptamers, comprising: (a) contacting a pool of aptamer candidates to a sample comprising a target molecule; (b) removing unbound aptamer candidates; (c) contacting the sample with a ligand to the target molecule; and (d) isolating aptamer candidates that are disassociated from the target molecule by competition with the ligand, thereby selecting the group of aptamers that bind the same target as the ligand. The target molecule can be a protein, including without limitation a microvesicle surface antigen. The target molecule is tethered to a substrate. In some embodiments, the target molecule is a surface antigen of a microvesicle and the microvesicle is tethered to a substrate. The ligand can be a small molecule or protein, e.g., the ligand can be an antibody. Steps (a)-(d) can be repeated at least 1, 2, 3, 4, 5, 6, 7, 8, 9, 10, 11, 12, 13, 14, 15, 16, 17, 18, 19 or 20 times, wherein the aptamer candidates isolated in the step (d) are used the pool of aptamer candidates input into step (a) in each iteration. The method may further comprise identifying the members of the selected group of aptamers, optionally wherein the identifying is performed by high throughput sequencing, amplification or hybridization. The first sample may be a diseased sample while the second sample comprises a control sample, optionally wherein the control sample is a non-disease sample. Alternately, the first sample may be a control sample while the second sample comprises a disease sample, optionally wherein the control sample is a non-disease sample.

In a related aspect, the invention provides a method of selecting one or more aptamer that bind a target of interest, comprising: (a) separating the target from a first biological sample to form a target depleted biological sample; (b) tethering the separated target to a substrate; (c) mixing the tethered target with an interfering biological sample; (d) contacting the mixture from (c) with a starting aptamer library; and (e) recovering members of the aptamer library that preferentially bind the tethered target, thereby selecting the one or more aptamer that bind the target. The substrate can be a bead or planar surface. The interfering biological sample may comprise the target depleted biological sample from (a). The target can be a microvesicle. In some embodiments, the target comprises a microvesicle of interest and the interfering biological sample comprises a non-target microvesicle. The non-target microvesicle can be tethered to a different substrate than the target microvesicle prior to step (c). In some embodiments, the substrate comprises a magnetic bead and the different substrate comprises a non-magnetic bead, or the substrate comprises a non-magnetic bead and the different substrate comprises a magnetic bead.

The first biological sample and/or interfering biological sample can be any useful can be any useful biological sample as disclosed herein. For example, they may comprise a bodily fluid. The bodily fluid may include without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, Cowper's fluid, pre-ejaculatory fluid, female ejaculate, sweat, fecal matter, hair, tears, cyst fluid, pleural fluid, peritoneal fluid, malignant fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids. In an embodiment, the first biological sample comprises a diseased sample and the interfering biological sample comprises a non-disease sample. Alternatively, the first biological sample may comprise a non-disease sample while the interfering biological sample comprises a disease sample.

The invention provides methods of screening a library of binding agents such as aptamers to identify binding agents to a target of interest. In an aspect, the invention provides a method for identifying a plurality of target ligands comprising: (a) contacting a reference microvesicle population with a plurality of ligands that are capable of binding one or more microvesicle surface markers; (b) isolating a plurality of reference ligands, wherein the plurality of reference ligands comprise a subset of the plurality of ligands that do not have an affinity for the reference microvesicle population; (c) contacting one or more test microvesicle with the plurality of reference ligands; and (d) identifying a subset of ligands from the the plurality of reference ligands that form complexes with a surface marker on the one or more test microvesicle, thereby identifying the plurality of target ligands. The method may further comprise identifying the surface marker of the target microvesicle. The plurality of ligands can be aptamers and/or antibodies.

In a related aspect, the invention provides a method of identifying an aptamer specific to a target of interest, comprising: (a) contacting a pool of candidate aptamers with one or more assay components, wherein the assay components do not comprise the target of interest; (b) recovering the members of the pool of candidate aptamers that do not bind to the one or more assay components in (a); (c) contacting the members of the pool of candidate aptamers recovered in (b) with the target of interest in the presence of one or more confounding target; and (d) recovering a candidate aptamer that binds to the target of interest in step (c), thereby identifying the aptamer specific to the target of interest. The method can remove candidate aptamers that bind non-target molecules. Steps (a)-(b) can be repeated at least 1, 2, 3, 4, 5, 6, 7, 8, 9, 10, 11, 12, 13, 14, 15, 16, 17, 18, 19 or at least 20 times before step (c) is performed. In addition, steps (c)-(d) can be repeated at least 1, 2, 3, 4, 5, 6, 7, 8, 9, 10, 11, 12, 13, 14, 15, 16, 17, 18, 19 or at least 20 times before identifying the aptamer specific to the target of interest. The starting pool of candidate aptamers can include at least $10^6$, $10^7$, $10^8$, $10^9$, $10^{10}$, $10^{11}$, $10^{12}$, $10^{13}$ $10^{14}$, $10^{15}$, $10^{16}$, $10^{17}$, or at least $10^{18}$ nucleic acid sequences. The one or more assay components can include without limitation one or more of a substrate, a bead, a planar array, a column, a tube, a well, or a filter.

In an embodiment, the target of interest and the one or more confounding target comprise proteins. The target of interest and the one or more confounding target may also comprise a microvesicle. In some embodiments, the target of interest and the one or more confounding target comprise one or more microvesicle surface antigen. The microvesicle surface antigen can be selected from Tables 3, 4 and/or 26. By way of non-limiting example, the target of interest can be a protein selected from the group consisting of SSX4, SSX2, PBP, KLK2, SPDEF, while the one or more confounding target comprises the other members of the group.

The one or more microvesicle surface antigen can be a biomarker of a disease or disorder, including without limitation those disclosed herein. In some embodiments, the disease comprises a cancer, a premalignant condition, an inflammatory disease, an immune disease, an autoimmune disease or disorder, a cardiovascular disease or disorder, neurological disease or disorder, infectious disease or pain. The cancer can be an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sezary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenstrim macroglobulinemia; or Wilm's tumor. The premalignant condition may be Barrett's Esophagus. In some embodiments, the autoimmune disease comprises inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. In other embodiments, the cardiovascular disease comprises atherosclerosis, congestive heart failure, vulnerable plaque, stroke, ischemia, high blood pressure, stenosis, vessel occlusion or a thrombotic event. The neurological disease may include without limitation Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain may include fibromyalgia, chronic neuropathic pain, or peripheral neuropathic pain. In embodiments, the infectious disease comprises a bacterial infection, viral infection, yeast infection, Whipple's Disease, Prion Disease, cirrhosis, methicillin-resistant *staphylococcus aureus*, HIV, HCV, hepatitis, syphilis, meningitis, malaria, tuberculosis, influenza.

The invention provides methods for identifying binding agents comprising contacting a plurality of extracellular microvesicles with a randomly generated library of binding agents, and identifying a subset of the library of binding agents that have an affinity to one or more components of the extracellular microvesicles. The binding agents can be aptamers and/or antibodies.

The ligands including oligonucleotide aptamers identified by the methods of the invention can be used in assays to characterize a phenotype of a sample, e.g., to provide a diagnosis, prognosis and/or theranosis of a disease or disorder. Such method of characterizing a phenotype may comprise contacting a test biological sample with the one or more ligand or aptamer aptamer that bind a target of interest. The phenotype may include detecting a disease or disorder as disclosed herein.

The invention further provides a kit comprising a reagent for carrying out the methods of screening ligand and aptamer libraries against one or more target of interest. The invention also provides for use of the reagent for carrying out the methods of screening ligand and aptamer libraries against one or more target of interest. The reagent may comprise an aptamer library or composition disclosed herein and/or other components as disclosed herein.

The methods of screening ligand and aptamer libraries against one or more target of interest can further include identifying one or more target of the selected ligands/aptamers. Such methods are disclosed herein and/or known in the art. See, e.g., FIG. 14. In such an aspect, the invention provides a method of identifying a target of a binding agent comprising: (a) contacting the binding agent with the target to bind the target with the binding agent, wherein the target comprises a surface antigen of a microvesicle; (b) disrupting the microvesicle under conditions which do not disrupt the binding of the target with the binding agent; (c) isolating the complex between the target and the binding agent; and (d) identifying the target bound by the binding agent. The binding agent may be a ligand or an aptamer identified by the screening methods above or elsewhere herein. See, e.g., FIGS. 13A-13B. The target of the binding agent can be any appropriate biomarker, including a protein, nucleic acid, lipid, carbohydrate, or microvesicle.

In some embodiments, the target is cross-linked to the binding agent prior to step (b). The cross-linking may comprise photocrosslinking, an imidoester crosslinker, dimethyl suberimidate, an N-Hydroxysuccinimide-ester crosslinker, bissulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl]carbodiimide hydrochloride (EDC or EDAC), Succinimidyl-4-(N-maleimidomethyl)cyclohexane-1-carboxylate (SMCC), and Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithioproprionate (Sulfo-SBED), 2-[N2-(4-Azido-2,3,5,6-tetrafluorobenzoyl)-N6-(6-biotin-amidocaproyl)-L-lysinyl]ethyl methanethiosulfonate (Mts-Atf-Biotin), 2-{N2-[N6-(4-Azido-2,3,5,6-tetrafluorobenzoyl-6-amino-caproyl)-N6-(6-biotinamidocaproyl)-L-lysinylamido]}ethyl methanethiosultonate (Mts-Atf-LC-Biotin), a photoreactive amino acid, L-Photo-Leucine, L-Photo-Methionine, an N-Hydroxysuccinimide (NHS) crosslinker, an NHS-Azide reagent, NHS-Azide, NHS-PEG4-Azide, NHS-PEG12-Azide, an NHS-Phosphine reagent, NHS-Phosphine, Sulfo-NHS-Phosphine, or any combination or modification thereof. Disrupting the microvesicle in step (b) can include use of one or more of a detergent, a surfactant, a solvent, an enzyme, mechanical shear, bead milling, homogenation, microfluidization, sonication, French Press, impingement, a colloid mill, decompression, osmotic shock, thermolysis, freeze-thaw, and desiccation. The enzyme can be one or more of lysozyme, lysostaphin, zymolase, cellulase, mutanolysin, a glycanase, a protease, and mannase. Useful detergents include one or more of a octylthioglucoside (OTG), octyl beta-glucoside (OG), a nonionic detergent, Triton X, Tween 20, a fatty alcohol, a cetyl alcohol, a stearyl alcohol, cetostearyl alcohol, an oleyl alcohol, a polyoxyethylene glycol alkyl ether (Brij), octaethylene glycol monododecyl ether, pentaethylene glycol monododecyl ether, a polyoxypropylene glycol alkyl ether, a glucoside alkyl ether, decyl glucoside, lauryl glucoside, octyl glucoside, a polyoxyethylene glycol octylphenol ethers, a polyoxyethylene glycol alkylphenol ether, nonoxynol-9, a glycerol alkyl ester, glyceryl laurate, a polyoxyethylene glycol sorbitan alkyl esters, polysorbate, a sorbitan alkyl ester, cocamide MEA, cocamide DEA, dodecyldimethylamine oxide, a block copolymers of polyethylene glycol and polypropylene glycol, poloxamers, polyethoxylated tallow amine (POEA), a zwitterionic detergent, 3-[(3-cholamidopropyl)dimethylammonio]-1-propanesulfonate (CHAPS), a linear alkylbenzene sulfonate (LAS), a alkyl phenol ethoxylate (APE), cocamidopropyl hydroxysultaine, a betaine, cocamidopropyl betaine, lecithin, an ionic detergent, sodium dodecyl sulfate (SDS), cetrimonium bromide (CTAB), cetyl trimethylammonium chloride (CTAC), octenidine dihydrochloride, cetylpyridinium chloride (CPC), benzalkonium chloride (BAC), benzethonium chloride (BZT), 5-Bromo-5-nitro-1,3-dioxane, dimethyldioctadecylammonium chloride, dioctadecyldimethylammonium bromide (DODAB), sodium deoxycholate, nonyl phenoxypolyethoxylethanol (Tergitol-type NP-40; NP-40), ammonium lauryl sulfate, sodium laureth sulfate (sodium lauryl ether sulfate (SLES)), sodium myreth sulfate, an alkyl carboxylate, sodium stearate, sodium lauroyl sarcosinate, a carboxylate-based fluorosurfactant, perfluorononanoate, perfluorooctanoate (PFOA or PFO), and a biosurfactant.

In an embodiment, the binding agent is tethered to a substrate. See, e.g., FIG. 14. The substrate can be a microsphere or a planar substrate. The binding agent can be labeled. In some embodiments, isolating the complex between the target and the binding agent comprises capturing the binding agent via the label. The label can be a biotin label.

In embodiments wherein the target comprises a protein, identifying the target may comprise use of mass spectrometry (MS), peptide mass fingerprinting (PMF; protein fingerprinting), sequencing, N-terminal amino acid analysis, C-terminal amino acid analysis, Edman degradation, chromatography, electrophoresis, two-dimensional gel electrophoresis (2D gel), antibody array, and immunoassay.

The invention further provides a kit comprising a reagent for carrying out the methods of target identification. The invention also provides for use of the reagent for carrying out the methods of target identification. The reagent may comprise various substrates, linkers, detergents, and/or other components as disclosed herein.

The invention provides compositions and methods to facilitate aptamer library screening and aptamer-based assays. These include without limitation negative control and blocking aptamers. In such an aspect, the invention provides a nucleic acid comprising a sequence at least 50, 60, 70, 75, 80, 85, 90, 91, 92, 93, 94, 95, 96, 97, 98, 99, or 100% homologous to a sequence selected from the group consisting of any of SEQ ID NOs. 230938-231008. The invention also provides a nucleic acid comprising a sequence selected from the group consisting of any of SEQ ID NOs. 230938-231008. The invention further provides an isolated nucleic acid comprising a sequence at least 50, 60, 70, 75, 80, 85, 90, 91, 92, 93, 94, 95, 96, 97, 98, 99, or 100% homologous to a sequence selected from the group consisting of any of SEQ ID NOs. 230938-231008. The invention provides an isolated nucleic acid comprising a sequence selected from the group consisting of any of SEQ ID NOs. 230938-231008. The nucleic acids can be further modified to comprise at least one chemical modification. The modification may include without limitation a chemical substitution at a sugar position; a chemical substitution at a phosphate position; and a chemical substitution at a base position of the nucleic acid. The modification can be selected from the group consisting of: incorporation of a modified nucleotide, 3' capping, a 2'-modified pyrimidine, biotinylation, conjugation to an amine linker, conjugation to a high molecular weight, non-immunogenic compound, conjugation to a lipophilic compound. In embodiments, the non-immunogenic, high molecular weight compound is a polyalkylene glycol, e.g, polyethylene glycol.

The invention provides a composition comprising a nucleic acid above, and also a kit comprising a nucleic acid above or the composition. The invention further provides a negative control composition comprising a non-target binding nucleic acid bound to a substrate. The non-target binding nucleic acid may be covalently bound to a substrate. Alternately, the non-target binding nucleic acid may be non-covalently bound to a substrate. The non-target binding nucleic acid can be a nucleic acid above (e.g., as relates to any of SEQ ID NOs. 230938-231008). The non-target binding nucleic acid may comprise a scrambled sequence of any of SEQ ID NOs. 1-241535 or a functional fragment thereof. A scrambled sequence includes a sequence that is randomly rearranged in whole or in part.

In a related aspect, the invention provides a method of detecting a presence or level of a biological entity in a biological sample suspected of containing the biological entity, comprising: (a) providing a composition comprising a substrate and a negative control composition as described above, wherein the substrate comprises one or more binding agent to the biological entity; (b) contacting the biological sample with the composition provided in step (a); (c) detecting a target signal corresponding to the amount of biological entity recognized by the one or more binding agent in step (b); and (d) normalizing the target signal detected in step (c) to a control signal corresponding to the amount of signal produced by the negative control composition, thereby detecting the presence or level of the biological entity in the biological sample. Normalizing the target signal may comprise subtracting the control signal from the target signal.

In an embodiment, the one or more binding agent comprises an antibody or aptamer. The biological entity can be a protein. The biological entity can also be a microvesicle. In some embodiments, the one or more binding agent is specific to a microvesicle surface antigen, including without limitation a microvesicle surface antigen selected from any of Tables 3-4, or 26. The biological entity, e.g., a protein, microvesicle or microvesicle surface antigen, can be chosen as a biomarker of a disease or disorder. In such cases, the method may provide a diagnosis, prognosis or theranosis of the disease or disorder as further described herein.

The invention further provides a kit comprising a reagent for carrying out the method. The invention also provides for use of the reagent for carrying out the methods. The reagent may comprise the negative control composition.

In another related aspect, the invention provides a blocking composition comprising a non-target binding nucleic acid. The non-target binding nucleic acid may comprise a nucleic acid disclosed above, e.g., as relates to any of SEQ ID NOs. 230938-231008. The blocking composition can further include one or more component selection from the group consisting of bovine serum albumin (BSA), casein, pepticase, a non-ionic surfactants, Tween® 20, Triton® X-100), a non-reacting antibody or fragment thereof, FSG (fish skin gelatin), pure gelatin, a gelatin hydrolase, polyethylene glycol (PEG), non-reacting sera, and a non-reacting protein.

In still another related aspect, the invention provides method of detecting a presence or level of a biological entity in a biological sample suspected of containing the biological entity, comprising: (a) contacting a substrate with the blocking composition described above, wherein the substrate comprises one or more binding agent to the biological entity; (b) contacting the biological sample with the blocked substrate provided in step (a); and (c) detecting whether the biological entity is recognized by the one or more binding agent in step (b), thereby detecting the presence or level of the biological entity in the biological sample.

In an embodiment, the one or more binding agent comprises an antibody or aptamer. The biological entity can be a protein. The biological entity can also be a microvesicle. In some embodiments, the one or more binding agent is specific to a microvesicle surface antigen, including without limitation a microvesicle surface antigen selected from any of Tables 3-4, or 26. The biological entity, e.g., a protein, microvesicle or microvesicle surface antigen, can be chosen as a biomarker of a disease or disorder. In such cases, the method may provide a diagnosis, prognosis or theranosis of the disease or disorder as further described herein.

The invention further provides a kit comprising a reagent for carrying out the method. The invention also provides for use of the reagent for carrying out the methods. The reagent may comprise the negative control composition.

In an aspect, the invention provides an aptamer that specifically binds to a functional group. The functional group binding aptamer may comprise a nucleic acid disclosed above, e.g., as relates to any of SEQ ID NOs. 230938-231008. In some embodiments, the functional group binding aptamer serves as a blocking agent by blocking various functional groups and may therefore be used to enhance an assay's performance.

The functional group can be selected from the group consisting of a hydrocarbon, a halogen, a group containing oxygen (i.e., C—O bonds), a group containing nitrogen, a group containing sulfur, a group containing phosphorus, or a group containing boron. In some embodiments, the hydrocarbon is selected from the group consisting of alkanes, alkenes, alkynes, benzene derivatives, toluene derivatives, branched or ring alkanes, carbocations and carboanions. In other embodiments, the halogen is selected from the group consisting of haloalkanes, fluoroalkanes, chloroalkanes, bromoalkanes and iodoalkanes. In still other embodiments, the group containing oxygen is selected from the group consisting of alcohols, ketones, aldehydes, acyl halides, carbonates, carboxylates, carboxylic acids, esters, hydroperoxides, ethers, hemiacetals, hemiketals, acetals, ketals, orthoesters, and orthocarbonates. The group containing nitrogen can be selected from the group consisting of amides, amines, imines, imides, azides, azo compounds, cyanates, nitrates, nitriles, nitrites, nitro compounds, nitroso compounds, and pyridine derivatives. The group containing sulfur can be selected from the group consisting of thiols, sulfides, disulfides, sulfoxides, sulfones, sulfunic acids, sulfonic acids, thiocyantes, isothyanates, thiones, and thials. In an embodiment, the group containing phosphorus is selected from the group consisting of phosphines, phosphanes, phophonic acids, phosphates, and phosphodiesters. The group containing boron may be selected from the group consisting of boronic acids, boronic esters, borinic acids and borinic esters.

The functional group can be selected from the group consisting of acetals, acyl groups, acyl halides, alkenyl groups, alkoxides, alkoxy groups, alkynyl groups, amides, amine oxides, amines, carbodiimides, carboximidates, carboxylic acids, cyanamides, cyanates, dithiocarbamates, enols, esters, ethers, hydrazines, hydrazones, hydroxamic acids, imides, isocyanates, isocyanides, isothiocyanates, ketals, ketenes, ketones, leaving groups, nitriles, organohalides, organophosphorus, orthoesters, oximes, phosphonofluoridates, phosphonothioates, phosphoramidothioates, phosphorodithioates, phosphorofluoridates, phosphorothioates, protecting groups, pyrophosphates, semicarbazides, semicarbazones, sulfamates, sulfonate esters, sulfones, sulfonic acids, sulfonyl groups, sulfoximines, sulfuryl compounds, thioamides, thiocyanates, thioesters, thiolates, thiones, thiophosphoryl compounds, and thiosulfinates. The functional group can also be selected from the group consisting of acetal, acetoxy group, acetylide, acid anhydride, activating group, acyl chloride, acyl halide, acylal, acyloin, acylsilane, alcohol, aldehyde, aldimine, alkane, alkene, alkoxide, alkyl cycloalkane, alkyl nitrites, alkyne, allene, amide, amidine, aminal, amine oxide, azide, azine, aziridine, azoxy, bifunctional, bisthiosemicarbazone, biuret, boronic acid, carbamate, carbamino, carbazide, carbene, carbinol, carbonate ester, carbonyl, carboxamide, carboximidate, carboxylic acid, chloroformate, cumulene, cyanate ester, cyanimide, cyanohydrin, deactivating groups, depside, diazo, diol, dithiocarbamate, enamine, enediyne, enol, enol ether, enone, enyne, episulfide, epoxide, ester, ether, fluorosulfonate, halohydrin, haloketone, hemiacetal, hemiaminal, hemithioacetal, hydrazide, hydrazone, hydroxamic acid, hydroxyl, hydroxylamine, imine, iminium, isothiouronium, ketene, ketenimine, ketone, ketyl, lactam, lactol, lactone, methine, methyl group, nitrate, nitrile ylide, nitrilimine, nitro compound, nitroamine, nitronate, nitrone, nitronium ion, nitrosamine, nitroso, orthoester, osazone, oxaziridine, oxime, n-oxoammonium salt, peroxide, peroxy acid, persistent carbene, phenols, phosphaalkene, phosphaalkyne, phosphate, phosphinate, phosphine, phosphine oxide, phosphinite, phosphonate, phosphonite, phosphonium, phosphorane, s-nitrosothiol, schiff base, selenol, selenonic acid, selone, semicarbazide, semicarbazone, silyl enol ether, silyl ether, sulfenamide, sulfenic acid, sulfenyl chloride, sulfide, sulfilimine, sulfinamide, sulfinic acid, sulfite ester, sulfonamide, sulfonanilide, sulfonate, sulfonyl, sulfonyl halide, sulfoxide, sulfuryl, sultone, tellurol, thial, thioacetal, thioamide, thiocarbamate, thiocarboxy, thiocyanate, thioester, thioether, thioketal, thioketone, thiol, thiolactone, thiourea, tosylhydrazone, triazene, triol, urea, vanillyl, xanthate, ylide, and ynolate. In some embodiments, the functional group comprises a carboxyl group, an amino group, a hydroxyl group, a hydrazide group and/or a chloromethyl group. For example, the functional group can be a carboxyl group.

The invention further provides a composition comprising the functional group binding aptamer and a substrate. The substate can be any useful substrate, e.g., a planar substrate or a microsphere. See, e.g., FIGS. 16A-16B. The substrate can be modified, e.g., with one or more modification selected from the group consisting of carboxyl-modified, amino-modified, hydroxyl-modified, hydrazide-modified, chloromethyl-modified, and a combination thereof. In an embodiment, the substrate comprises a carboxyl group. The aptamer may be bound to the carboxyl group. The substrate can also comprise a binding agent, including without limitation an antibody or aptamer. In some embodiments, the composition further comprises a microvesicle.

The invention further provides a kit comprising a reagent and use of the reagent, wherein the reagent may comprise a functional group binding aptamer and/or the composition described above.

In a related aspect, the invention provides a method comprising contacting a functional group binding aptamer as described above with a substrate, e.g., a planar substrate or a microsphere. As described above, the substrate can be modified, e.g., with one or more modification selected from the group consisting of carboxyl-modified, amino-modified, hydroxyl-modified, hydrazide-modified, chloromethyl-modified, and a combination thereof. In an embodiment, the substrate comprises a carboxyl group. The aptamer may be bound to the carboxyl group. The substrate can also comprise a binding agent, including without limitation an antibody or aptamer. In some embodiments, the composition further comprises. The method can further comprise contacting the substrate with a target of the binding agent, e.g., a protein or a microvesicle.

The invention further provides a kit comprising a reagent for carrying out the method. The invention also provides for use of the reagent for carrying out the methods. The reagent may comprise a functional group binding aptamer and/or the composition described above.

In another related aspect, the invention provides a method of detecting a presence or level of a biological entity in a biological sample suspected of containing the biological entity, comprising: (a) providing a composition comprising one or more binding agent specific to the biological entity attached to a carboxylated substrate, wherein the carboxylated substrate is bound to a functional group binding aptamer; (b) contacting the biological sample with the composition provided in step (a); and (c) detecting whether the biological entity is recognized by the one or more binding agent in step (b), thereby detecting the presence or level of the biological entity in the biological sample. The functional group binding aptamer can be a functional group binding aptamer described above.

In an embodiment, the one or more binding agent comprises an antibody or aptamer. The biological entity can be a protein. The biological entity can also be a microvesicle. In some embodiments, the one or more binding agent is specific to a microvesicle surface antigen, including without limitation a microvesicle surface antigen selected from any of Tables 3-4, or 26. The biological entity, e.g., a protein, microvesicle or microvesicle surface antigen, can be chosen as a biomarker of a disease or disorder. In such cases, the method may provide a diagnosis, prognosis or theranosis of the disease or disorder as further described herein.

The invention further provides a kit comprising a reagent for carrying out the method. The invention also provides for use of the reagent for carrying out the methods. The reagent may comprise one or more of the functional group binding aptamer and the substrate.

In another related aspect, the invention provides a method for enhancing binding comprising: (a) contacting a substrate with an aptamer capable of binding a carboxyl group, wherein the substrate also comprises one or more selected nucleic acid or polypeptide molecules; and (b) contacting the substrate with a binding agent capable of binding the nucleic acid or polypeptide molecule, whereby the aptamer binding to the carboxyl group enhances the binding of the binding agent to the nucleic acid or polypeptide molecule. The functional group binding aptamer can be a functional group binding aptamer described above. The substate can be any useful substrate, e.g., a planar substrate or a microsphere. The nucleic acid or polypeptide can be covalently bound to a carboxyl group via an amide linkage. In some embodiments, the substrate comprises the binding agent.

The invention further provides a kit comprising a reagent for carrying out the method. The invention also provides for use of the reagent for carrying out the methods. The reagent may comprise one or more of the functional group binding aptamer and the substrate.

The invention provides compositions comprising a complex between a substrate and a sample, and methods of use thereof. In such an aspect, the invention provides a method of selecting one or more binding agent comprising: (a) contacting a substrate with a biological sample to allow formation of a substrate-biological sample complex; (b) contacting the substrate-biological sample complex with a plurality of candidate binding agents; and (c) identifying one or more member of the plurality of candidate binding agents that associates with the substrate-biological sample complex, thereby selecting the one or more binding agent. The one or more binding agent can be a nucleic acid, DNA molecule, RNA molecule, antibody, antibody conjugate, antibody fragment, aptamer, peptoid, zDNA, peptide nucleic acid (PNA), locked nucleic acid (LNA), lectin, polypeptide, peptide, dendrimer, membrane protein labeling agent, chemical compound, or a combination thereof. In some embodiments, the one or more binding agent comprises an aptamer.

The biological sample can be any useful sample, e.g., a tissue sample, a cell culture sample, or a biological fluid. In some embodiments, the biological sample comprises a bodily fluid, optionally wherein the bodily fluid comprises peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, umbilical cord blood, or a derivative of any thereof. The biological sample can include a heterogeneous microvesicle population or a homogeneous microvesicle population.

In some embodiments, the biological sample is a concentrated plasma sample, a serum sample, a clarified serum sample, or a clarified plasma sample. The clarified serum or clarified plasma sample may have reduced levels of one or more abundant protein as compared to an unclarified control sample. The one or more abundant protein can be a blood protein. Such abundant blood proteins include without limitation albumin, IgG, transferrin, fibrinogen, fibrin, IgA, α2-Macroglobulin, IgM, α1-Antitrypsin, complement C3, haptoglobulin, apolipoprotein A1, A3 and B; al-Acid Glycoprotein, ceruloplasmin, complement C4, C1q, IgD, prealbumin (transthyretin), plasminogen, a derivative of any thereof, and a combination thereof. The one or more abundant protein may comprise one or more of Albumin, Immunoglobulins, Fibrinogen, Prealbumin, Alpha 1 antitrypsin, Alpha 1 acid glycoprotein, Alpha 1 fetoprotein, Haptoglobin, Alpha 2 macroglobulin, Ceruloplasmin, Transferrin, complement proteins C3 and C4, Beta 2 microglobulin, Beta lipoprotein, Gamma globulin proteins, C-reactive protein (CRP), Lipoproteins (chylomicrons, VLDL, LDL, HDL), other globulins (types alpha, beta and gamma), Prothrombin, Mannose-binding lectin (MBL), a derivative of any thereof, and a combination thereof.

In some embodiments, the one or more abundant protein is separated from the clarified serum or clarified plasma sample in whole or in part by chromatography, size exclusion chromatography, ion exchange chromatography, affinity chromatography, immunoaffinity, precipitation, or a combination thereof. The one or more abundant protein can also be separated from the clarified serum or clarified plasma sample after contacting the biological sample with thromboplastin. In some embodiments, at least 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99% or 100% of the one or more abundant protein is separated from the clarified serum or clarified plasma sample as compared to the unclarified control sample.

The substrate-biological sample complex may comprise a cross-link between the substrate and a component of the biological sample, optionally wherein the cross-link comprises a photocrosslink, an imidoester crosslinker, dimethyl suberimidate, a lipid crosslinker, an N-Hydroxysuccinimide-ester crosslinker, bissulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl]carbodiimide hydrochloride (EDC or EDAC), Succinimidyl-4-(N-maleimidomethyl)cyclohexane-1-carboxylate (SMCC), a Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithioproprionate (Sulfo-SBED), 2-[N2-(4-Azido-2,3,5,6-tetrafluorobenzoyl)-N6-(6-biotin-amidocaproyl)-L-lysinyl]ethyl methanethiosulfonate (Mts-Atf-Biotin), 2-{N2-[N6-(4-Azido-2,3,5,6-tetrafluorobenzoyl-6-amino-caproyl)-N6-(6-biotinamidocaproyl)-L-lysinylamido]}ethyl methanethiosultonate (Mts-Atf-LC-Biotin), a photoreactive amino acid, L-Photo-Leucine, L-Photo-Methionine, an N-Hydroxysuccinimide (NHS) crosslinker, an NHS-Azide reagent, NHS-Azide, NHS-PEG4-Azide, NHS-PEG12-Azide, an NHS-Phosphine reagent, NHS-Phosphine, Sulfo-NHS-Phosphine, or any combination or modification thereof. The substrate can be directly crosslinked to the component of the biological sample, or the substrate can be crosslinked to the component of the biological sample via a linker.

In some embodiments of the method, the component of the biological sample comprises a microvesicle. When a linker is used, the linker may be embedded within the microvesicle membrane. See, e.g., FIGS. 10A-10B. Such linker may include without limitation a functionalized lipid, optionally wherein the functionalized lipid comprises 16:0 Biotinyl PE 1,2-dipalmitoyl-sn-glycero-3-phosphoethanolamine-N-(biotinyl) (sodium salt), 18:1 Biotinyl PE 1,2-dioleoyl-sn-glycero-3-phosphoethanolamine-N-(biotinyl) (sodium salt), 16:0 Biotinyl Cap PE 1,2-dipalmitoyl-sn-glycero-3-phosphoethanolamine-N-(cap biotinyl) (sodium salt), 18:1 Biotinyl Cap PE 1,2-dioleoyl-sn-glycero-3-phosphoethanolamine-N-(cap biotinyl) (sodium salt), or a combination thereof.

The linker can also comprise a diacyl glycerol, diacyl phosphoglycerol (phospholipid) or sterol, dialkyl glycerol, dialkyl- or diacyl-1-amino-2,3-dihydroxypropane, long-chain alkyl or acyl, sphingolipid, ceramide, phospholipid, glycosyl phosphatidylinositol (GPI) membrane anchor sequence, glycophospholipid membrane anchor, membrane receptor fragment, protein-binding receptor, metal-chelating receptor, immunoglobulin Fc-binding receptor, cytokine or growth factor-binding receptor, drug-binding receptor, lipid mimicking receptor, transmembrane receptor, synthetic protein-binding receptor, synthetic metal-chelating receptor, synthetic immunoglobulin Fc-binding receptor, synthetic cytokine or growth factor-binding receptor, synthetic drug-binding receptor, synthetic lipid mimicking receptor, synthetic transmembrane receptor, protein, peptide, peptidomimetic, sphingolipid, steroid, cholesterol, dihydrocholesterol, ergosterol, brassicasterol, cholesterylamine, dihydrocholesterylamine, ergosterylamine, brassicasterylamine, 3-cholesterylamine, 3-dihydrocholesterylamine, 3-ergosterylamine, 3-brassicasterylamine 3β-cholesterylamine, 3β-dihydrocholesterylamine, 3β-ergosteiylamine, 3β-brassicasterylamine, or a functional fragment or derivative of any thereof.

In some embodiments of the method, the substrate is conjugated to a binding agent to the component of the biological sample. The binding agent may be an antibody, an aptamer, or a lectin, optionally wherein the lectin comprises concanavalin A (ConA). The component of the biological sample can be a microvesicle, optionally wherein the binding agent comprises a binding agent to a microvesicle surface antigen. See, e.g., FIGS. 7A-7D.

The method may further comprise identifying the one or more binding agent, e.g., using methods disclosed herein.

In a related aspect, the invention provides a composition of matter comprising a substrate-microvesicle complex, wherein the substrate comprises a synthetic substrate. Such substrate may be a bead, a well, or a planar substrate, optionally wherein the bead comprises a magnetic bead, or a polystyrene bead.

The invention further provides a kit comprising a reagent for carrying out the method. The invention also provides for use of the reagent for carrying out the methods. The reagent may comprise one or more of a substrate-microvesicle complex and a linker agent. The reagent may comprise the composition above.

In another related aspect, the invention provides method of producing a stable substrate-microvesicle complex comprising contacting a substrate with a microvesicle, wherein the substrate is functionalized with a chemical group capable of binding directly to at least one component present on the surface of the microvesicle. The substrate can be a bead, a well, a matrix or a planar substrate. The at least one component may be a useful biomarker, including without limitation a peptide, polypeptide, protein, lipid, carbohydrate, a derivative thereof, or a combination thereof. The chemical group can be a peptoid, zDNA, peptide nucleic acid (PNA), locked nucleic acid (LNA), lectin, peptide/polypeptide, dendrimer, membrane protein labeling agent, chemical compound, a photocrosslink, an imidoester crosslinker, dimethyl suberimidate, a lipid crosslinker, an N-Hydroxysuccinimide-ester crosslinker, bissulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl]carbodiimide hydrochloride (EDC or EDAC), Succinimidyl-4-(N-maleimidomethyl)cyclohexane-1-carboxylate (SMCC), a Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithioprionate (Sulfo-SBED), 2-[N2-(4-Azido-2,3,5,6-tetrafluorobenzoyl)-N6-(6-biotin-amido-caproyl)-L-lysinyl]ethyl methanethiosulfonate (Mts-Atf-Biotin), 2-{N2-[N6-(4-Azido-2,3,5,6-tetrafluorobenzoyl-6-amino-caproyl)-N6-(6-biotinamidocaproyl)-L-lysinylamido]}ethyl methanethiosultonate (Mts-Atf-LC-Biotin), a photoreactive amino acid, L-Photo-Leucine, L-Photo-Methionine, an N-Hydroxysuccinimide (NHS) crosslinker, an NHS-Azide reagent, NHS-Azide, NHS-PEG4-Azide, NHS-PEG12-Azide, an NHS-Phosphine reagent, NHS-Phosphine, Sulfo-NHS-Phosphine, or a combination thereof. In an embodiment, the chemical group comprises a hydrocarbon, a halogen, a group containing oxygen (i.e., C—O bonds), a group containing nitrogen, a group containing sulfur, a group containing phosphorus, a group containing boron, or a combination thereof. In another embodiment, the hydrocarbon is selected from the group consisting of alkanes, alkenes, alkynes, benzene derivatives, toluene derivatives, branched or ring alkanes, carbocations and carboanions. In still another embodiment, the halogen is selected from the group consisting of haloalkanes, fluoroalkanes, chloroalkanes, bromoalkanes and iodoalkanes. The group containing oxygen can be selected from the group consisting of alcohols, ketones, aldehydes, acyl halides, carbonates, carboxylates, carboxylic acids, esters, hyperoxides, ethers, hemiacetals, hemiketals, acetals, ketals, orthoesters, and orthocarbonates. The group containing nitrogen can be selected from the group consisting of amides, amines, imines, imides, azides, azo compounds, cyanates, nitrates, nitriles, nitrites, nitro compounds, nitroso compounds, and pyridine derivatives. In some embodiments, the group containing sulfur is selected from the group consisting of thiols, sulfides, disulfides, sulfoxides, sulfones, sulfunic acids, sulfonic acids, thiocyantes, isothyanates, thiones, and thials. The group containing phosphorus can be selected from the group consisting of phosphines, phosphanes, phophonic acids, phosphates, and phosphodiesters. In embodiments, the group containing boron is selected from the group consisting of boronic acids, boronic esters, borinic acids and borinic esters.

The chemical group may comprise an acetal, acyl group, acyl halide, alkenyl group, alkoxide, alkoxy group, alkynyl group, amide, amine oxide, amine, carbodiimide, carboximidate, carboxylic acid, cyanamide, cyanate, dithiocarbamate, enol, ester, ether, hydrazine, hydrazone, hydroxamic acid, imide, isocyanate, isocyanide, isothiocyanate, ketal, ketene, ketone, leaving group, nitrile, organohalide, organophosphorus, orthoester, oxime, phosphonofluoridate, phosphonothioate, phosphoramidothioate, phosphorodithioate, phosphorofluoridate, phosphorothioate, protecting group, pyrophosphate, semicarbazide, semicarbazone, sulfamate, sulfonate ester, sulfone, sulfonic acid, sulfonyl group, sulfoximine, sulfuryl compound, thioamide, thiocyanate, thioester, thiolate, thione, thiophosphoryl compound, and/or thiosulfinates. The chemical group may be selected from the group consisting of acetal, acetoxy group, acetylide, acid anhydride, activating group, acyl chloride, acyl halide, acylal, acyloin, acylsilane, alcohol, aldehyde, aldimine, alkane, alkene, alkoxide, alkyl cycloalkane, alkyl nitrites, alkyne, allene, amide, amidine, aminal, amine oxide, azide, azine, aziridine, azoxy, bifunctional, bisthiosemicarbazone, biuret, boronic acid, carbamate, carbamino, carbazide, carbene, carbinol, carbonate ester, carbonyl, carboxamide, carboximidate, carboxylic acid, chloroformate, cumulene, cyanate ester, cyanimide, cyanohydrin, deactivating groups, depside, diazo, diol, dithiocarbamate, enamine, enediyne, enol, enol ether, enone, enyne, episulfide, epoxide, ester, ether, fluorosulfonate, halohydrin, haloketone, hemiacetal, hemiaminal, hemithioacetal, hydrazide, hydrazone, hydroxamic acid, hydroxyl, hydroxylamine, imine, iminium, isothiouronium, ketene, ketenimine, ketone, ketyl, lactam, lactol, lactone, methine, methyl group, nitrate, nitrile ylide, nitrilimine, nitro compound, nitroamine, nitronate, nitrone, nitronium ion, nitrosamine, nitroso, orthoester, osazone, oxaziridine, oxime, n-oxoammonium salt, peroxide, peroxy acid, persistent carbene, phenols, phosphaalkene, phosphaalkyne, phosphate, phosphinate, phosphine, phosphine oxide, phosphinite, phosphonate, phosphonite, phosphonium, phosphorane, s-nitrosothiol, schiff base, selenol, selenonic acid, selone, semicarbazide, semicarbazone, silyl enol ether, silyl ether, sulfenamide, sulfenic acid, sulfenyl chloride, sulfide, sulfilimine, sulfinamide, sulfinic acid, sulfite ester, sulfonamide, sulfonanilide, sulfonate, sulfonyl, sulfonyl halide, sulfoxide, sulfuryl, sultone, tellurol, thial, thioacetal, thioamide, thiocarbamate, thiocarboxy, thiocyanate, thioester, thioether, thioketal, thioketone, thiol, thiolactone, thiourea, tosylhydrazone, triazene, triol, urea, vanillyl, xanthate, ylide, and ynolate. In embodiments, the chemical group comprises a carboxyl group, an amino group, a hydroxyl group, a hydrazide group and/or a chloromethyl group. For example, the chemical group can be a carboxyl group.

In a related aspect, the invention provides a composition of matter comprising a substrate-microvesicle complex, wherein the substrate comprises a synthetic substrate as described above. The invention further provides a stabilized microvesicle composition comprising a microvesicle directly conjugated to an inert substrate. The substrate can be a bead, a well, a matrix, or a planar substrate, optionally wherein the bead comprises a magnetic bead, or a polystyrene bead. See, e.g., any of FIGS. 7A-7D, FIGS. 10A-12E.

The invention also provides a kit comprising one or more reagent for carrying out the method above, optionally wherein the one or more reagent comprises one or more of a substrate-microvesicle complex and a linker agent. The invention further provides use of the one or more reagent for carrying out the method.

In an aspect, the invention provides a method of visualizing a microvesicle. See, e.g., FIGS. 11A-12E. The method comprises: (a) contacting the microvesicle with a binding agent to a microvesicle antigen, wherein the binding agent comprises a label; (b) fixing the contacted microvesicle to a scanning electron microscopy (SEM) substrate; (c) sputter coating the fixed microvesicle; and (d) using SEM to visualize the microvesicle and the label. The microvesicle can be attached to a substrate prior to step (a). The microvesicle may be attached to the substrate via covalent linkage. The microvesicle may also be attached to the substrate via immunoaffinity linkage. See, e.g., FIGS. 7A-7E; FIG. 10B.

The binding agent can be directly labeled or the binding agent can be indirectly labeled. The indirect label may comprise a labeled binding agent that forms a complex with the binding agent to the microvesicle antigen. Any useful binding agent can be used in the method, e.g., an antibody, a functional antibody fragment, or an aptamer.

The microvesicle antigen can be chosen to visualize a microvesicle of interest. In some embodiments, the antigen is selected from Table 3, Table 4, or Table 26. For example, the microvesicle antigen can be to a general vesicle marker, including without limitation a tetraspanin, CD9, CD63, CD81, or any combination thereof.

The sputter coating may comprise gold and/or palladium coating. The sputter coating may comprise carbon coating. In some embodiments, the SEM comprises secondary electrons (SE) mode to visualize the microvesicles and/or back scattered electrons (BSE) mode to visualize the label. The label can comprise gold.

In embodiments of the invention, the (i) the microvesicle is attached to a substrate prior to step (a) via covalent linkage; (ii) the binding agent to the microvesicle antigen is an indirectly labeled antibody, wherein the indirect label comprises a gold labeled antibody that forms a complex with the antibody to the microvesicle antigen; (iii) the microvesicle antigen is CD9; (iv) the sputter coating comprises carbon coating; and (v) the SEM comprises secondary electrons (SE) mode to visualize the microvesicles and/or back scattered electrons (BSE) mode to visualize the label.

The invention further provides kits and uses of one or more reagent for carrying out the methods of the invention. The one or more reagent may comprise any useful reagents for carrying out the subject methods, including without limitation aptamer libraries, substrates such as microbeads or planar arrays or wells, reagents for biomarker and/or microvesicle isolation, aptamers directed to specific targets, aptamer pools that facilitate detection of a biomarker/microvesicle population, reagents such as primers for nucleic acid sequencing or amplification, arrays for nucleic acid hybridization, detectable labels, solvents or buffers and the like, various linkers, various assay components, blockers, and the like. The one or more reagent may also comprise various compositions provided by the invention.

BRIEF DESCRIPTION OF THE DRAWINGS

FIGS. 1A-1F illustrate methods of assessing biomarkers such as microvesicle surface antigens. FIG. 1A is a schematic of a planar substrate coated with a capture agent, such as an aptamer or antibody, which captures vesicles expressing the target antigen of the capture agent. The capture agent may bind a protein expressed on the surface of vesicles shed from diseased cells ("disease vesicle"). The detection agent, which may also be an aptamer or antibody, carries a detectable label, here a fluorescent signal. The detection agent binds to the captured vesicle and provides a detectable signal via its fluorescent label. The detection agent can detect an antigen that is generally associated with vesicles, or is associated with a cell-of-origin or a disease, e.g., a cancer. FIG. 1B is a schematic of a particle bead conjugated with a capture agent, which captures vesicles expressing the target antigen of the capture agent. The capture agent may bind a protein expressed on the surface of vesicles shed from diseased cells ("disease vesicle"). The detection agent, which may also be an aptamer or antibody, carries a detectable label, here a fluorescent signal. The detection agent binds to the captured vesicle and provides a detectable signal via its fluorescent label. The detection agent can detect an antigen that is generally associated with vesicles, or is associated with a cell-of-origin or a disease, e.g., a cancer. FIG. 1C is an example of a screening scheme that can be performed by using different combinations of capture and detection agents to the indicated biomarkers. The biomarker combinations can be detected using assays as shown in FIGS. 1A-1B. FIGS. 1D-1E present illustrative schemes for capturing and detecting vesicles to characterize a phenotype. FIG. 1F presents illustrative schemes for assessing vesicle payload to characterize a phenotype.

FIG. 2A illustrates aptamer candidate 201 bound to target 202. In step i), a competing antibody 203 is then added to the reaction. FIG. 2B illustrates candidate antibody 203 competing with aptamer candidate 201 at the epitope of the antibody. Aptamer candidate 201 is displaced by the antibody and then collected.

FIG. 5A illustrates a secondary structure of a 32-mer oligonucleotide, Aptamer 4, with sequence 5'-CCCCCCGAATCACAT-GACTTGGGCGGGGGTCG (SEQ ID NO. 1). In the figure, the sequence is shown with 6 thymine nucleotides added to the end, which can act as a spacer to attach a biotin molecule. This particular oligo has a high binding affinity to the target, EpCAM (see Table 5). Additional candidate EpCAM binders are identified by modeling the entire database of sequenced oligos to the secondary structure of this oligo. FIG. 5B illustrates another 32-mer oligo with sequence 5'-ACCGGATAGCGGTTGGAGGCGTGCTCCACTCG (SEQ ID NO. 3840) that has a different secondary structure than the aptamer in FIG. 5A. This aptamer is also shown with a 6-thymine tail.

FIGS. 7A-7D illustrate methods to attach microvesicles to a substrate. FIG. 7A illustrates direct conjugation of a carboxylated microsphere to a vesicle surface antigen. FIG. 7B illustrates anchoring of a microvesicle to a microsphere via a biotin functionalized lipid anchor. FIG. 7C illustrates antibody binding to a vesicle surface antigen, wherein the antibody is conjugated to a carboxylated microsphere. FIG. 7D illustrates aptamer binding to a vesicle surface antigen, wherein the aptamer is conjugated to a carboxylated microsphere.

FIG. 9A shows Vcap derived microvesicle titers against Ab conjugated beads. MagPlex beads were conjugated with antibodies to EpCAM, CD63 or CD81 according to manufacturer's protocol (Luminex Corp., Austin Tex.). The microvesicles were detected with phycoerythrin (PE) labeled antibodies to CD9, a common microvesicle surface protein. The Y-axis in the figures shows median fluorescent intensity (MFI) of the detected microvesicles. The X-axis indicates the amount of VCap vesicle input. FIG. 9B shows capture of microvesicles from plasma using bead conjugated anti-CD63 antibodies for capture and PE-labeled anti-CD9 antibodies for detection. The plot shows detection of various numbers of microspheres as indicated for microvesicles isolated under various conditions: microvesicles after ultracentrifugation with sucrose gradient without or with 0.1% Tween 20 ("UC-PBS" and "UC-PBST", respectively), concentrated microvesicles from plasma subjected to ultrafiltration ("N3-Conc"), and microvesicles purified using ExoQuick methodology ("N3-Exo"). "Control (PBS)" samples do not have microvesicles. FIG. 9C shows titration of microvesicles captured with antibody-conjugated microspheres with input comprising plasma-derived microvesicles from two patients. In all samples, 5000 microspheres were detected. Microvesicles (cMVs) were captured using bead conjugated anti-CD63 antibodies or anti-CD81 antibodies, as indicated, and PE-labeled anti-CD9 antibodies for detection. The X-axis in the plots indicates the number of vesicles in the sample. FIG. 9D shows the stability of the antibody-captured microvesicle-microsphere complexes. Microvesicles (cMVs) from three patients were purified using the ExoQuick technology then captured using bead conjugated anti-CD81 antibodies and PE-labeled anti-CD9 antibodies for detection. Approximately 8.96E+07 microvesicles per 5000 beads were detected before and after incubation of the bead-captured microvesicles for 1 h at 800 rpm at room temperature.

FIGS. 10A-10P illustrate anchoring of microvesicles to microspheres using a heterobifunctional linker with a lipid functional group. FIG. 10A illustrates an illustrative lipid anchor: 1,2-dipalmitoyl-sn-glycero-3-phosphoethanolamine-N-(cap biotinyl) (sodium salt) ("16:0 Biotinyl Cap PE"). Molecular weight is 1053.394. FIG. 10A shows the chemical structure above and 3D structure below. The crosslinker is available from Avanti Polar Lipids, Inc., Alabaster, Ala. FIGS. 10C-10E illustrate flow cytometry of VCAP microvesicles anchored to microspheres using the lipid anchor in FIGS. 10A-10B. The microvesicles were detected using PE labeled anti-CD9 and anti-CD63 antibodies. In FIG. 10C, no lipid anchor was used. FIG. 10D is identical to FIG. 10C with the addition of the lipid anchor. These data illustrate enriched microvesicles conjugated to microspheres via the lipid anchor. FIG. 10E and FIG. 10F illustrate independent replication of the experiments in FIG. 10C and FIG. 10D, respectively. FIGS. 10K-10L illustrate detection of vesicles isolated from plasma samples using ultracentrifugation. Otherwise, experimental conditions are as in FIG. 10C and FIG. 10D, respectively. FIG. 10M and FIG. 10N illustrate detection of VCAP microvesicles anchored to microspheres using the lipid anchor in FIGS. 10A-10B. The microvesicles were detected using PE labeled anti-CD9 and anti-CD63 antibodies. In FIG. 10M, conditions are similar to FIG. 10D and FIG. 10F. However, in the experiment shown in FIG. 10N, 30 mg/ml human serum albumin (HSA) was added to the samples prior to detection. FIGS. 10O-10P shows the MFI values of microsphere-conjugated microvesicles before (Day 0; FIG. 10O) and after (Day 12; FIG. 10P) 12 days of storage at −80° C. Vesicles isolated using different methods were tested as indicated by conditions along the X-axis: 1) ExoQuick™ Kit (System Biosciences, Inc., Mountain View, Calif.) followed by ultrafiltration; 2) ultracentrifugation; 3) ultracentrifugation followed by Exoquick; 4) ExoQuick to ExoMir™ Kit (Bioo Scientific Corp., Austin Tex.); 5) ultrafiltered VCAP vesicle prep #1; 6) ultrafiltered VCAP vesicle prep #2; and 7) ultrafiltration followed by ultracentrifugation.

FIGS. 11A-11M illustrate field emission scanning electron microscopy (FE-SEM) imaging used for evaluation of alternative protocols for tethering microvesicles isolated from plasma to the surface of microspheres. FIG. 11A shows a microsphere that has not been functionalized or conjugated. FIG. 11B shows direct conjugation of plasma microvesicles isolated using ultracentrifugation to non-magnetic beads. FIG. 11C shows a blow up of the indicated region of FIG. 11B. The arrows point to various microvesicles. FIG. 11D and FIG. 11E correspond to FIG. 11B and FIG. 11C, respectively, except that the beads are magnetic. FIGS. 11F-H show functionalized magnetic beads. FIG. 11F shows avidin conjugated beads functionalized with biotinylated concanavalin A (ConA), which is a lectin (i.e., a carbohydrate-binding protein) that binds specifically to certain structures found in various sugars, glycoproteins, and glycolipids, mainly internal and nonreducing terminal α-D-mannosyl and α-D-glucosyl groups. FIG. 11G shows avidin conjugated beads functionalized with a biotinylated lipid anchor. FIG. 11H shows beads directly conjugated with anti-CD9 antibodies. FIG. 11I shows bead capture of plasma microvesicles isolated using ultracentrifugation to ConA functionalized beads. FIG. 11J shows a blow up of the indicated region of FIG. 11I. The arrows point to various microvesicles. FIG. 11K shows bead capture of plasma microvesicles isolated using ultracentrifugation to lipid anchor functionalized beads. FIG. 11L shows a blow up of the indicated region of FIG. 11K. The arrows point to various microvesicles. FIG. 11M shows bead capture of plasma microvesicles isolated using ultracentrifugation to lipid anchor functionalized beads. FIG. 11N shows a blow up of the indicated region of FIG. 11M. The arrows point to various microvesicles.

FIGS. 12A-12B image microvesicles stained with 10 µg/ml anti CD9 primary antibody labeled in suspension. FIG. 12A shows SE imaging and FIG. 12B shows BSE imaging. In FIG. 12B, the gold nanoparticles are white bright spots pointed with arrows. Larger features are may be either inorganic matters (buffer crystals) or lipid plaques since they are more dense and seen at BSE. FIGS. 12C-12D image microvesicles stained with 10 µg/ml anti CD9 primary antibody labeled on glass slides. FIG. 12C shows SE imaging and FIG. 12D shows BSE imaging. In FIG. 12D, the gold nanoparticles are white bright spots pointed with arrows. FIG. 12E shows a BSE image (ImmunoGold) overlaid on top of SE images (microvesicles). Gold nanoparticles (10 nm) are depicted with arrows. Larger features are may be either inorganic matters (buffer crystals) or lipid plaques since they are more dense and seen at BSE.

FIGS. 13A-13B illustrate schemes for screening an aptamer library to identify one or more candidate aptamer. FIG. 13A illustrates a scheme 1300 for positive and optionally negative rounds of screening an oligonucleotide library against a target of interest. A library of oligo candidates is provided 1301. To perform positive selection, the oligos are contacted with the target of interest 1302. The mixture is washed to remove unbound oligos and then oligos are disassociated from the washed mixture and collected 1303. The collected oligos can be used as input to a new round of target binding, which can be repeated any number of times (indicated as 1 . . . n). Between rounds of positive selection, negative selection is optionally performed wherein oligos are contacted with one or more non-target entity 1304. During negative selection, oligos that do not bind the one or more non-target entity are retained and used as input to a new round of positive selection 1302. The oligos collected after the desired numbers of rounds of positive selection 1303 or negative selection 1304 are collected as candidate aptamers which are indicated to bind the target of interest 1305. FIG. 13B illustrates a scheme for selection of aptamers against cancer samples versus non-cancer control samples. The scheme shows 8 cancer samples (Ca1-Ca8) and 7 control samples (nCa1-nCa7) each consisting of individual samples or pooled samples. Seven different selections (Selection 1-Selection 7) are run in parallel. In each Selection, an input pool of candidate aptamers is enriched for aptamers against one of the cancer samples ("positive selection"), and then the pool is depleted of aptamers against one of the control samples ("negative selection"). This process is repeated as indicated. The ordering of the samples is altered in each Selection to avoid selection bias. The aptamers remaining after the last round of positive selection comprise the selected aptamers, which can then be further developed, e.g., as part of an assay to differentiate cancer from non-cancer samples. The aptamer pools can be sequenced after each round to track enrichment, depletion, potential issues, etc.

FIG. 15A is a schematic 1500 showing an assay configuration that can be used to detect and/or quantify a target of interest. In the figure, capture aptamer 1502 is attached to substrate 1501. Target of interest 1503 is bound by capture aptamer 1502. Detection aptamer 1504 is also bound to target of interest 1503. Detection aptamer 1504 carries label 1505 which can be detected to identify target captured to substrate 1501 via capture aptamer 1502. FIG. 15B is a schematic 1510 showing use of an aptamer pool to characterize a phenotype. A pool of aptamers to a target of interest is provided 1511. The pool is contacted with a test sample to be characterized 1512. The mixture is washed to remove unbound aptamers. The remaining aptamers are disassociated and collected 1513. The collected aptamers are identified and the identity of the retained aptamers is used to characterize the phenotype 1514.

In FIG. 17A, binding agent 1704 is also attached to the substrate 1703. The binding agent has specificity for target 1705, which may be a biological entity such as a protein, nucleic acid, microvesicle, cell, or a portion of any thereof. In FIG. 17B, target 1705, which may be a biological entity such as a protein, nucleic acid, microvesicle, cell, or a portion of any thereof, is also attached to the substrate 1703. Target 1705 is bound by binding agent 1704.

FIG. 18A) EGFR; FIG. 18B) PBP; FIG. 18C) EpCAM; and FIG. 18D) KLK2. Fluorescently labeled Aptamer 4 was used as a detector in the microbead assay. The figures show average median fluorescence values (MFI values) for three cancer (C1-C3) and three normal samples (N1-N3) in each plot. In each plot, the samples from left to right are ordered as: C1, C2, C3, N1, N2, N3.

FIGS. 19A-19C illustrate aptamers recovered from each starting library after one (FIG. 19A), two (FIG. 19B), and three rounds (FIG. 19C) of positive selection. FIGS. 19D-19E illustrate screening 25 aptamer libraries after the 13th round of positive selection against specific antigen (5 libraries per each of SSX2, SSX4, PBP, KLK2 and SPDEF antigens). The aptamer selection after this round was modified with the inclusion of confounding antigens as described in Example 9 (section entitled "Round 14 of positive selection was modified as follows"). DNA aptamers bound to magnetic beads conjugated to the aptamers of interest were extracted from beads and re-amplified. The recovered libraries are shown in FIG. 19D. FIG. 19E shows the libraries after an addition round of selection and stringent wash.

FIGS. 24A-24B illustrate results for two non-antigen binding aptamers, which each serve as negative controls. The two non-antigen binding aptamers are: Neg 5 (FIG. 24A): 5' TGCAAGCTGC TAATCAGCGA TGCTCTTTGG AGTTTTTT (Biotin) 3' (SEQ ID NO. 230936); Neg 9 (FIG. 24B): 5' TTTCAAGGCA CTCGTGTTCC CGACATGAGT GTTTTTT (Biotin) 3' (SEQ ID NO. 230937).

DETAILED DESCRIPTION OF THE INVENTION

Figure 1A:
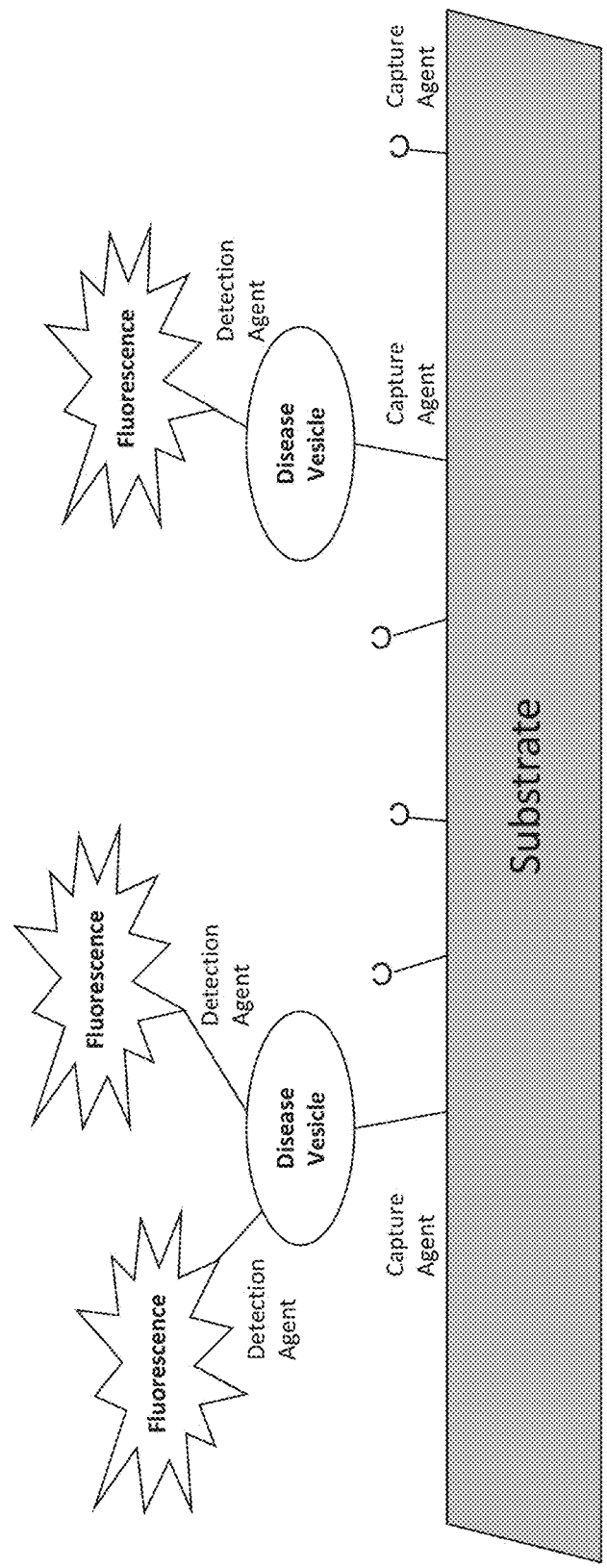

The details of one or more embodiments of the invention are set forth in the accompanying description below. Although any methods and materials similar or equivalent to those described herein can be used in the practice or testing of the present invention, the preferred methods and materials are now described. Other features, objects, and advantages of the invention will be apparent from the description. In the specification, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present Specification will control.

Disclosed herein are compositions and methods that can be used to assess a biomarker profile, which can include a presence or level of one or more biomarkers. The compositions and methods of the invention comprise the use of aptamers that bind microvesicle surface antigens or a functional fragment thereof. The antigens typically comprise proteins or polypeptides but can be any component displayed on a microvesicle surface including lipids and/or carbohydrates. In general, aptamers disclosed are nucleic acid molecules, including DNA and RNA, and variations thereof. The methods disclosed comprise diagnostic processes and techniques using one or more aptamer of the invention, to determine level or presence of relevant microvesicle surface antigens or a functional fragment thereof. Alternatively, an aptamer of the invention can also be used as a binding agent to capture, isolate, or enrich, a cell, cell fragment, vesicle or any other fragment or complex that comprises the surface antigens or functional fragments thereof.

The compositions and methods of the invention comprise individual aptamers that are identified for use in assessing a biomarker profile. The invention further discloses compositions and methods of aptamer pools that can be used to detect a biomarker profile in a given sample.

Aptamers and aptamer sequences disclosed in the compositions and methods of the invention may be identified herein in the form of DNA or RNA. Unless otherwise specified, one of skill in the art will appreciate that an aptamer may generally be synthesized as either form of nucleic acid and carry various chemical modifications and remain within the scope of the invention.

In addition, an aptamer of the invention can also be used to provide in vitro or in vivo detection or imaging, to provide any diagnostic readout (e.g., diagnostic, prognostic or theranostic). Separately, an aptamer of the invention can also be used in for treatment or as a therapeutic to specifically target a cell, tissue or organ.

Aptamers

SELEX

A suitable method for generating an aptamer is with the process entitled "Systematic Evolution of Ligands by Exponential Enrichment" ("SELEX") generally described in, e.g., U.S. patent application Ser. No. 07/536,428, filed Jun. 11, 1990, now abandoned, U.S. Pat. No. 5,475,096 entitled "Nucleic Acid Ligands", and U.S. Pat. No. 5,270,163 (see also WO 91/19813) entitled "Nucleic Acid Ligands". Each SELEX-identified nucleic acid ligand, i.e., each aptamer, is a specific ligand of a given target compound or molecule. The SELEX process is based on the unique insight that nucleic acids have sufficient capacity for forming a variety of two- and three-dimensional structures and sufficient chemical versatility available within their monomers to act as ligands (i.e., form specific binding pairs) with virtually any chemical compound, whether monomeric or polymeric. Molecules of any size or composition can serve as targets.

SELEX relies as a starting point upon a large library or pool of single stranded oligonucleotides comprising randomized sequences. The oligonucleotides can be modified or unmodified DNA, RNA, or DNA/RNA hybrids. In some examples, the pool comprises 100% random or partially random oligonucleotides. In other examples, the pool comprises random or partially random oligonucleotides containing at least one fixed and/or conserved sequence incorporated within randomized sequence. In other examples, the pool comprises random or partially random oligonucleotides containing at least one fixed and/or conserved sequence at its 5' and/or 3' end which may comprise a sequence shared by all the molecules of the oligonucleotide pool. Fixed sequences are sequences such as hybridization sites for PCR primers, promoter sequences for RNA polymerases (e.g., T3, T4, T7, and SP6), restriction sites, or homopolymeric sequences, such as poly A or poly T tracts, catalytic cores, sites for selective binding to affinity columns, and other sequences to facilitate cloning and/or sequencing of an oligonucleotide of interest. Conserved sequences are sequences, other than the previously described fixed sequences, shared by a number of aptamers that bind to the same target.

The oligonucleotides of the pool preferably include a randomized sequence portion as well as fixed sequences necessary for efficient amplification. Typically the oligonucleotides of the starting pool contain fixed 5' and 3' terminal sequences which flank an internal region of 30-50 random nucleotides. The randomized nucleotides can be produced in a number of ways including chemical synthesis and size selection from randomly cleaved cellular nucleic acids. Sequence variation in test nucleic acids can also be introduced or increased by mutagenesis before or during the selection/amplification iterations.

The random sequence portion of the oligonucleotide can be of any length and can comprise ribonucleotides and/or deoxyribonucleotides and can include modified or non-natural nucleotides or nucleotide analogs. See, e.g. U.S. Pat. No. 5,958,691; U.S. Pat. No. 5,660,985; U.S. Pat. No. 5,958,691; U.S. Pat. No. 5,698,687; U.S. Pat. No. 5,817,635; U.S. Pat. No. 5,672,695, and PCT Publication WO 92/07065. Random oligonucleotides can be synthesized from phosphodiester-linked nucleotides using solid phase oligonucleotide synthesis techniques well known in the art. See, e.g., Froehler et al., Nucl. Acid Res. 14:5399-5467 (1986) and Froehler et al., Tet. Lett. 27:5575-5578 (1986). Random oligonucleotides can also be synthesized using solution phase methods such as triester synthesis methods. See, e.g., Sood et al., Nucl. Acid Res. 4:2557 (1977) and Hirose et al., Tet. Lett., 28:2449 (1978). Typical syntheses carried out on automated DNA synthesis equipment yield $10^{14}$-$10^{16}$ individual molecules, a number sufficient for most SELEX experiments. Sufficiently large regions of random sequence in the sequence design increases the likelihood that each synthesized molecule is likely to represent a unique sequence.

The starting library of oligonucleotides may be generated by automated chemical synthesis on a DNA synthesizer. To synthesize randomized sequences, mixtures of all four nucleotides are added at each nucleotide addition step during the synthesis process, allowing for random incorporation of nucleotides. As stated above, in one embodiment, random oligonucleotides comprise entirely random sequences; however, in other embodiments, random oligonucleotides can comprise stretches of nonrandom or partially random sequences. Partially random sequences can be created by adding the four nucleotides in different molar ratios at each addition step.

The starting library of oligonucleotides may be for example, RNA, DNA, or RNA/DNA hybrid. In those instances where an RNA library is to be used as the starting library it is typically generated by transcribing a DNA library in vitro using T7 RNA polymerase or modified T7 RNA polymerases and purified. The library is then mixed with the target under conditions favorable for binding and subjected to step-wise iterations of binding, partitioning and amplification, using the same general selection scheme, to achieve virtually any desired criterion of binding affinity and selectivity. More specifically, starting with a mixture containing the starting pool of nucleic acids, the SELEX method includes steps of: (a) contacting the mixture with the target under conditions favorable for binding; (b) partitioning unbound nucleic acids from those nucleic acids which have bound specifically to target molecules; (c) dissociating the nucleic acid-target complexes; (d) amplifying the nucleic acids dissociated from the nucleic acid-target complexes to yield a ligand-enriched mixture of nucleic acids; and (e) reiterating the steps of binding, partitioning, dissociating and amplifying through as many cycles as desired to yield highly specific, high affinity nucleic acid ligands to the target molecule. In those instances where RNA aptamers are being selected, the SELEX method further comprises the steps of: (i) reverse transcribing the nucleic acids dissociated from the nucleic acid-target complexes before amplification in step (d); and (ii) transcribing the amplified nucleic acids from step (d) before restarting the process.

Within a nucleic acid mixture containing a large number of possible sequences and structures, there is a wide range of binding affinities for a given target. A nucleic acid mixture comprising, for example, a 20 nucleotide randomized segment can have $4^{20}$ candidate possibilities. Those which have the higher affinity constants for the target are most likely to bind to the target. After partitioning, dissociation and amplification, a second nucleic acid mixture is generated, enriched for the higher binding affinity candidates. Additional rounds of selection progressively favor better ligands until the resulting nucleic acid mixture is predominantly composed of only one or a few sequences. These can then be cloned, sequenced and individually tested for binding affinity as pure ligands or aptamers.

Cycles of selection and amplification are repeated until a desired goal is achieved. In the most general case, selection/amplification is continued until no significant improvement in binding strength is achieved on repetition of the cycle. The method is typically used to sample approximately $10^{14}$ different nucleic acid species but may be used to sample as many as about $10^{18}$ different nucleic acid species. Generally, nucleic acid aptamer molecules are selected in a 5 to 20 cycle procedure. In one embodiment, heterogeneity is introduced only in the initial selection stages and does not occur throughout the replicating process.

In one embodiment of SELEX, the selection process is so efficient at isolating those nucleic acid ligands that bind most strongly to the selected target, that only one cycle of selection and amplification is required. Such an efficient selection may occur, for example, in a chromatographic-type process wherein the ability of nucleic acids to associate with targets bound on a column operates in such a manner that the column is sufficiently able to allow separation and isolation of the highest affinity nucleic acid ligands.

In many cases, it is not necessarily desirable to perform the iterative steps of SELEX until a single nucleic acid ligand is identified. The target-specific nucleic acid ligand solution may include a family of nucleic acid structures or motifs that have a number of conserved sequences and a number of sequences which can be substituted or added without significantly affecting the affinity of the nucleic acid ligands to the target. By terminating the SELEX process prior to completion, it is possible to determine the sequence of a number of members of the nucleic acid ligand solution family. The invention provides for the identification of aptamer pools and uses thereof that jointly can be used to characterize a test sample. For example, the aptamer pools can be identified through rounds of positive and negative selection to identify microvesicle indicative of a disease or condition. The invention further provides use of such aptamer pools to detect and/or quantify such microvesicles in a sample, thereby allowing a diagnosis, prognosis or theranosis to be provided.

A variety of nucleic acid primary, secondary and tertiary structures are known to exist. The structures or motifs that have been shown most commonly to be involved in non-Watson-Crick type interactions are referred to as hairpin loops, symmetric and asymmetric bulges, pseudoknots and myriad combinations of the same. Almost all known cases of such motifs suggest that they can be formed in a nucleic acid sequence of no more than 30 nucleotides. For this reason, it is often preferred that SELEX procedures with contiguous randomized segments be initiated with nucleic acid sequences containing a randomized segment of between about 20 to about 50 nucleotides and in some embodiments, about 30 to about 40 nucleotides. In one example, the 5'-fixed:random:3'-fixed sequence comprises a random sequence of about 30 to about 50 nucleotides.

The core SELEX method has been modified to achieve a number of specific objectives. For example, U.S. Pat. No. 5,707,796 describes the use of SELEX in conjunction with gel electrophoresis to select nucleic acid molecules with specific structural characteristics, such as bent DNA. U.S. Pat. No. 5,763,177 describes SELEX based methods for selecting nucleic acid ligands containing photoreactive groups capable of binding and/or photocrosslinking to and/or photoinactivating a target molecule. U.S. Pat. No. 5,567,588 and U.S. Pat. No. 5,861,254 describe SELEX based methods which achieve highly efficient partitioning between oligonucleotides having high and low affinity for a target molecule. U.S. Pat. No. 5,496,938 describes methods for obtaining improved nucleic acid ligands after the SELEX process has been performed. U.S. Pat. No. 5,705,337 describes methods for covalently linking a ligand to its target.

SELEX can also be used to obtain nucleic acid ligands that bind to more than one site on the target molecule, and to obtain nucleic acid ligands that include non-nucleic acid species that bind to specific sites on the target. SELEX provides means for isolating and identifying nucleic acid ligands which bind to any envisionable target, including large and small biomolecules such as nucleic acid-binding proteins and proteins not known to bind nucleic acids as part of their biological function as well as cofactors and other small molecules. For example, U.S. Pat. No. 5,580,737 discloses nucleic acid sequences identified through SELEX which are capable of binding with high affinity to caffeine and the closely related analog, theophylline.

Counter-SELEX is a method for improving the specificity of nucleic acid ligands to a target molecule by eliminating nucleic acid ligand sequences with cross-reactivity to one or more non-target molecules.

Counter-SELEX is comprised of the steps of: (a) preparing a candidate mixture of nucleic acids; (b) contacting the candidate mixture with the target, wherein nucleic acids having an increased affinity to the target relative to the candidate mixture may be partitioned from the remainder of the candidate mixture; (c) partitioning the increased affinity nucleic acids from the remainder of the candidate mixture; (d) dissociating the increased affinity nucleic acids from the target; e) contacting the increased affinity nucleic acids with one or more non-target molecules such that nucleic acid ligands with specific affinity for the non-target molecule(s) are removed; and (f) amplifying the nucleic acids with specific affinity only to the target molecule to yield a mixture of nucleic acids enriched for nucleic acid sequences with a relatively higher affinity and specificity for binding to the target molecule. As described above for SELEX, cycles of selection and amplification are repeated as necessary until a desired goal is achieved.

One potential problem encountered in the use of nucleic acids as therapeutics and vaccines is that oligonucleotides in their phosphodiester form may be quickly degraded in body fluids by intracellular and extracellular enzymes such as endonucleases and exonucleases before the desired effect is manifest. The SELEX method thus encompasses the identification of high-affinity nucleic acid ligands containing modified nucleotides conferring improved characteristics on the ligand, such as improved in vivo stability or improved delivery characteristics. Examples of such modifications include chemical substitutions at the ribose and/or phosphate and/or base positions. SELEX identified nucleic acid ligands containing modified nucleotides are described, e.g., in U.S. Pat. No. 5,660,985, which describes oligonucleotides containing nucleotide derivatives chemically modified at the 2' position of ribose, 5 position of pyrimidines, and 8 position of purines, U.S. Pat. No. 5,756,703 which describes oligonucleotides containing various 2'-modified pyrimidines, and U.S. Pat. No. 5,580,737 which describes highly specific nucleic acid ligands containing one or more nucleotides modified with 2'-amino (2'-$NH_2$), 2'-fluoro (2'-F), and/or 2'-O-methyl (2'-OMe) substituents.

Modifications of the nucleic acid ligands contemplated in this invention include, but are not limited to, those which provide other chemical groups that incorporate additional charge, polarizability, hydrophobicity, hydrogen bonding, electrostatic interaction, and fluxionality to the nucleic acid ligand bases or to the nucleic acid ligand as a whole. Modifications to generate oligonucleotide populations which are resistant to nucleases can also include one or more substitute internucleotide linkages, altered sugars, altered bases, or combinations thereof. Such modifications include, but are not limited to, 2'-position sugar modifications, 5-position pyrimidine modifications, 8-position purine modifications, modifications at exocyclic amines, substitution of 4-thiouridine, substitution of 5-bromo or 5-iodo-uracil; backbone modifications, phosphorothioate or allyl phosphate modifications, methylations, and unusual base-pairing combinations such as the isobases isocytidine and isoguanosine. Modifications can also include 3' and 5' modifications such as capping.

In one embodiment, oligonucleotides are provided in which the P(O)O group is replaced by P(O)S ("thioate"), P(S)S ("dithioate"), P(O)$NR_2$ ("amidate"), P(O)R, P(O)OR', CO or $CH_2$ ("formacetal") or 3'-amine (—NH—$CH_2$—$CH_2$—), wherein each R or R' is independently H or substituted or unsubstituted alkyl. Linkage groups can be attached to adjacent nucleotides through an —O—, —N—, or —S— linkage. Not all linkages in the oligonucleotide are required to be identical. As used herein, the term phosphorothioate encompasses one or more non-bridging oxygen atoms in a phosphodiester bond replaced by one or more sulfur atoms.

In further embodiments, the oligonucleotides comprise modified sugar groups, for example, one or more of the hydroxyl groups is replaced with halogen, aliphatic groups, or functionalized as ethers or amines. In one embodiment, the 2'-position of the furanose residue is substituted by any of an O-methyl, O-alkyl, O-allyl, S-alkyl, S-allyl, or halo group. Methods of synthesis of 2'-modified sugars are described, e.g., in Sproat, et al., Nucl. Acid Res. 19:733-738 (1991); Cotten, et al., Nucl. Acid Res. 19:2629-2635 (1991); and Hobbs, et al., Biochemistry 12:5138-5145 (1973). Other modifications are known to one of ordinary skill in the art. Such modifications may be pre-SELEX process modifications or post-SELEX process modifications (modification of previously identified unmodified ligands) or may be made by incorporation into the SELEX process.

Pre-SELEX process modifications or those made by incorporation into the SELEX process yield nucleic acid ligands with both specificity for their SELEX target and improved stability, e.g., in vivo stability. Post-SELEX process modifications made to nucleic acid ligands may result in improved stability, e.g., in vivo stability without adversely affecting the binding capacity of the nucleic acid ligand.

The SELEX method encompasses combining selected oligonucleotides with other selected oligonucleotides and non-oligonucleotide functional units as described in U.S. Pat. No. 5,637,459 and U.S. Pat. No. 5,683,867. The SELEX method further encompasses combining selected nucleic acid ligands with lipophilic or non-immunogenic high molecular weight compounds in a diagnostic or therapeutic complex, as described, e.g., in U.S. Pat. No. 6,011,020, U.S. Pat. No. 6,051,698, and PCT Publication No. WO 98/18480. These patents and applications teach the combination of a broad array of shapes and other properties, with the efficient amplification and replication properties of oligonucleotides, and with the desirable properties of other molecules.

The identification of nucleic acid ligands to small, flexible peptides via the SELEX method has also been explored. Small peptides have flexible structures and usually exist in solution in an equilibrium of multiple conformers, and thus it was initially thought that binding affinities may be limited by the conformational entropy lost upon binding a flexible peptide. However, the feasibility of identifying nucleic acid ligands to small peptides in solution was demonstrated in U.S. Pat. No. 5,648,214. In this patent, high affinity RNA nucleic acid ligands to substance P, an 11 amino acid peptide, were identified.

The aptamers with specificity and binding affinity to the target(s) of the present invention can be selected by the SELEX N process as described herein. As part of the SELEX process, the sequences selected to bind to the target are then optionally minimized to determine the minimal sequence having the desired binding affinity. The selected sequences and/or the minimized sequences are optionally optimized by performing random or directed mutagenesis of the sequence to increase binding affinity or alternatively to determine which positions in the sequence are essential for binding activity. Additionally, selections can be performed with sequences incorporating modified nucleotides to stabilize the aptamer molecules against degradation in vivo.

2' Modified SELEX

In order for an aptamer to be suitable for use as a therapeutic, it is preferably inexpensive to synthesize, safe and stable in vivo. Wild-type RNA and DNA aptamers are typically not stable is vivo because of their susceptibility to degradation by nucleases. Resistance to nuclease degradation can be greatly increased by the incorporation of modifying groups at the 2'-position.

Fluoro and amino groups have been successfully incorporated into oligonucleotide pools from which aptamers have been subsequently selected. However, these modifications greatly increase the cost of synthesis of the resultant aptamer, and may introduce safety concerns in some cases because of the possibility that the modified nucleotides could be recycled into host DNA by degradation of the modified oligonucleotides and subsequent use of the nucleotides as substrates for DNA synthesis.

Aptamers that contain 2'-O-methyl ("2'-OMe") nucleotides, as provided herein, may overcome many of these drawbacks. Oligonucleotides containing 2'-OMe nucleotides are nuclease-resistant and inexpensive to synthesize. Although 2'-OMe nucleotides are ubiquitous in biological systems, natural polymerases do not accept 2'-OMe NTPs as substrates under physiological conditions, thus there are no safety concerns over the recycling of 2'-OMe nucleotides into host DNA. The SELEX method used to generate 2'-modified aptamers is described, e.g., in U.S. Provisional Patent Application Ser. No. 60/430,761, filed Dec. 3, 2002, U.S. Provisional Patent Application Ser. No. 60/487,474, filed Jul. 15, 2003, U.S. Provisional Patent Application Ser. No. 60/517,039, filed Nov. 4, 2003, U.S. patent application Ser. No. 10/729,581, filed Dec. 3, 2003, and U.S. patent application Ser. No. 10/873,856, filed Jun. 21, 2004, entitled "Method for in vitro Selection of 2'-O-methyl substituted Nucleic Acids", each of which is herein incorporated by reference in its entirety.

Methods

Biomarker Detection and Diagnostics

The aptamers of the invention can be used in various methods to assess presence or level of biomarkers in a biological sample, e.g., biological entities of interest such as proteins, nucleic acids, or microvesicles. The aptamer functions as a binding agent to assess presence or level of the cognate target molecule. Therefore, in various embodiments of the invention directed to diagnostics, prognostics or theranostics, one or more aptamers of the invention are configured in a ligand-target based assay, where one or more aptamer of the invention is contacted with a selected biological sample, where the or more aptamer associates with or binds to its target molecules. Aptamers of the invention are used to identify candidate biosignatures based on the biological samples assessed and biomarkers detected. In further embodiments, aptamers may themselves provide a biosignature for a particular condition or disease. A biosignature refers to a biomarker profile of a biological sample comprising a presence, level or other characteristic that can be assessed (including without limitation a sequence, mutation, rearrangement, translocation, deletion, epigenetic modification, methylation, post-translational modification, allele, activity, complex partners, stability, half life, and the like) of one or more biomarker of interest. Biosignatures can be used to evaluate diagnostic and/or prognostic criteria such as presence of disease, disease staging, disease monitoring, disease stratification, or surveillance for detection, metastasis or recurrence or progression of disease. For example, methods of the invention using aptamers against microvesicle surface antigen are useful for correlating a biosignature comprising microvesicle antigens to a selected condition or disease. A biosignature can also be used clinically in making decisions concerning treatment modalities including therapeutic intervention. A biosignature can further be used clinically to make treatment decisions, including whether to perform surgery or what treatment standards should be used along with surgery (e.g., either pre-surgery or post-surgery). As an illustrative example, a biosignature of circulating biomarkers that indicates an aggressive form of cancer may call for a more aggressive surgical procedure and/or more aggressive therapeutic regimen to treat the patient.

A biosignature can be used in any methods disclosed herein, e.g., to assess whether a subject is afflicted with disease, is at risk for developing disease or to assess the stage or progression of the disease. For example, a biosignature can be used to assess whether a subject has prostate cancer, colon cancer, or other cancer as described herein. Furthermore, a biosignature can be used to determine a stage of a disease or condition, such as colon cancer. The biosignature/biomarker profile comprising a microvesicle can include assessment of payload within the microvesicle. For example, one or more aptamer of the invention can be used to capture a microvesicle population, thereby providing readout of microvesicle antigens, and then the payload content within the captured microvesicles can be assessed, thereby providing further biomarker readout of the payload content.

A biosignature for characterizing a phenotype may comprise any number of useful criteria. As described further below, the term "phenotype" as used herein can mean any trait or characteristic that is attributed to a biosignature/biomarker profile. A phenotype can be detected or identified in part or in whole using the compositions and/or methods of the invention. In some embodiments, at least one criterion is used for each biomarker. In some embodiments, at least 1, 2, 3, 4, 5, 6, 7, 8, 9, 10, 15, 20, 30, 40, 50, 60, 70, 80, 90 or at least 100 criteria are used. For example, for the characterizing of a cancer, a number of different criteria can be used when the subject is diagnosed with a cancer: 1) if the amount of microRNA in a sample from a subject is higher than a reference value; 2) if the amount of a microRNA within cell type specific vesicles (i.e. vesicles derived from a specific tissue or organ) is higher than a reference value; or 3) if the amount of microRNA within vesicles with one or more cancer specific biomarkers is higher than a reference value. Similar rules can apply if the amount of microRNA is less than or the same as the reference. The method can further include a quality control measure, such that the results are provided for the subject if the samples meet the quality control measure. In some embodiments, if the criteria are met but the quality control is questionable, the subject is reassessed.

Theranostics

A biosignature can be used in therapy related diagnostics to provide tests useful to diagnose a disease or choose the correct treatment regimen, such as provide a theranosis. Theranostics includes diagnostic testing that provides the ability to affect therapy or treatment of a diseased state.

Theranostics testing provides a theranosis in a similar manner that diagnostics or prognostic testing provides a diagnosis or prognosis, respectively. As used herein, theranostics encompasses any desired form of therapy related testing, including predictive medicine, personalized medicine, integrated medicine, pharmacodiagnostics and Dx/Rx partnering. Therapy related tests can be used to predict and assess drug response in individual subjects, i.e., to provide personalized medicine. Predicting a drug response can be determining whether a subject is a likely responder or a likely non-responder to a candidate therapeutic agent, e.g., before the subject has been exposed or otherwise treated with the treatment. Assessing a drug response can be monitoring a response to a drug, e.g., monitoring the subject's improvement or lack thereof over a time course after initiating the treatment. Therapy related tests are useful to select a subject for treatment who is particularly likely to benefit from the treatment or to provide an early and objective indication of treatment efficacy in an individual subject. Thus, a biosignature as disclosed herein may indicate that treatment should be altered to select a more promising treatment, thereby avoiding the great expense of delaying beneficial treatment and avoiding the financial and morbidity costs of administering an ineffective drug(s).

The compositions and methods of the invention can be used to identify or detect a biosignature that associated with selected diseases and disorders, which include, but are not limited to cardiovascular disease, cancer, infectious diseases, sepsis, neurological diseases, central nervous system related diseases, endovascular related diseases, and autoimmune related diseases. Therapy related diagnostics also aid in the prediction of drug toxicity, drug resistance or drug response. Therapy related tests may be developed in any suitable diagnostic testing format, which include, but are not limited to, e.g., immunohistochemical tests, clinical chemistry, immunoassay, cell-based technologies, nucleic acid tests or body imaging methods. Therapy related tests can further include but are not limited to, testing that aids in the determination of therapy, testing that monitors for therapeutic toxicity, or response to therapy testing. Thus, a biosignature can be used to predict or monitor a subject's response to a treatment. A biosignature can be determined at different time points for a subject after initiating, removing, or altering a particular treatment.

In some embodiments, the compositions and methods of the invention provide for a determination or prediction as to whether a subject is responding to a treatment is made based on a change in the amount of one or more components of a biosignature (i.e., the microRNA, vesicles and/or biomarkers of interest), an amount of one or more components of a particular biosignature, or the biosignature detected for the components. In another embodiment, a subject's condition is monitored by determining a biosignature at different time points. The progression, regression, or recurrence of a condition is determined. Response to therapy can also be measured over a time course. Thus, the invention provides a method of monitoring a status of a disease or other medical condition in a subject, comprising isolating or detecting a biosignature from a biological sample from the subject, detecting the overall amount of the components of a particular biosignature, or detecting the biosignature of one or more components (such as the presence, absence, or expression level of a biomarker). The biosignatures are used to monitor the status of the disease or condition.

One or more novel biosignatures of a vesicle can also be identified. For example, one or more vesicles can be isolated from a subject that responds to a drug treatment or treatment regimen and compared to a reference, such as another subject that does not respond to the drug treatment or treatment regimen. Differences between the biosignatures can be determined and used to identify other subjects as responders or non-responders to a particular drug or treatment regimen.

In some embodiments, a biosignature is used to determine whether a particular disease or condition is resistant to a drug, in which case a physician need not waste valuable time with such drug treatment. To obtain early validation of a drug choice or treatment regimen, a biosignature is determined for a sample obtained from a subject. The biosignature is used to assess whether the particular subject's disease has the biomarker associated with drug resistance. Such a determination enables doctors to devote critical time as well as the patient's financial resources to effective treatments.

Biosignatures can be used in the theranosis of a cancer, such as identifying whether a subject suffering from cancer is a likely responder or non-responder to a particular cancer treatment. The subject methods can be used to theranose cancers including those listed herein, e.g., in the "Phenotype" section above. These include without limitation lung cancer, non-small cell lung cancer small cell lung cancer (including small cell carcinoma (oat cell cancer), mixed small cell/large cell carcinoma, and combined small cell carcinoma), colon cancer, breast cancer, prostate cancer, liver cancer, pancreatic cancer, brain cancer, kidney cancer, ovarian cancer, stomach cancer, melanoma, bone cancer, gastric cancer, breast cancer, glioma, glioblastoma, hepatocellular carcinoma, papillary renal carcinoma, head and neck squamous cell carcinoma, leukemia, lymphoma, myeloma, or other solid tumors.

A biosignature of circulating biomarkers, including markers associated with a component present in a biological sample (e.g., cell, cell-fragment, cell-derived extracellular vesicle), in a sample from a subject suffering from a cancer can be used select a candidate treatment for the subject. The biosignature can be determined according to the methods of the invention presented herein. In some embodiments, the candidate treatment comprises a standard of care for the cancer. The treatment can be a cancer treatment such as radiation, surgery, chemotherapy or a combination thereof. The cancer treatment can be a therapeutic such as anticancer agents and chemotherapeutic regimens. Further drug associations and rules that are used in embodiments of the invention are found in U.S. patent application Ser. No. 12/658,770, filed Feb. 12, 2010; International PCT Patent Application PCT/US2010/000407, filed Feb. 11, 2010; International PCT Patent Application PCT/US2010/54366, filed Oct. 27, 2010; and U.S. Provisional Patent Application 61/427,788, filed Dec. 28, 2010; all of which applications are incorporated by reference herein in their entirety. See, e.g., "Table 4: Rules Summary for Treatment Selection" of PCT/US2010/54366.

Biomarker Detection

The compositions and methods of the invention can be used to assess any useful biomarkers in a biological sample for charactering a phenotype associated with the sample. Such biomarkers include all sorts of biological entities such as proteins, nucleic acids, lipids, carbohydrates, complexes of any thereof, and microvesicles. Various molecules associated with a microvesicle surface or enclosed within the microvesicle (referred to herein as "payload") can serve as biomarkers. The microvesicles themselves can also be used as biomarkers.

The aptamers of the invention can be used to assess levels or presence of a microvesicle population. See, e.g., FIGS.

15B-15C. The aptamers of the invention can also be used to assess levels or presence of their specific target molecule. See, e.g., FIG. 15A. In addition, aptamers of the invention are used to capture or isolated a component present in a biological sample that has the aptamer's target molecule present. For example, if a given microvesicle surface antigen is present on a cell, cell fragment or cell-derived extracellular vesicle. A binding agent to the biomarker, including without limitation an aptamer provided by the invention, may be used to capture or isolate the cell, cell fragment or cell-derived extracellular vesicles. See, e.g., FIGS. 1A-1B, 1D-1E. Such captured or isolated entities may be further characterized to assess additional surface antigens or internal "payload" molecules present (i.e., nucleic acid molecules, lipids, sugars, polypeptides or functional fragments thereof, or anything else present in the cellular milieu that may be used as a biomarker), where one or more biomarkers provide a biosignature to assess a desired phenotype, such a s disease or condition. See, e.g., FIG. 1F. Therefore, aptamers of the invention are used not only to assess one or more microvesicle surface antigen of interest but are also used to separate a component present in a biological sample, where the components themselves can be further assessed to identify a candidate biosignature.

The methods of the invention can comprise multiplex analysis of at least 2, 3, 4, 5, 6, 7, 8, 9, 10, 11, 12, 13, 14, 15, 16, 17, 18, 19, 20, 25, 50, 75 or 100 different biomarkers. For example, an assay of a heterogeneous population of vesicles can be performed with a plurality of particles that are differentially labeled. There can be at least 2, 3, 4, 5, 6, 7, 8, 9, 10, 11, 12, 13, 14, 15, 16, 17, 18, 19, 20, 25, 50, 75 or 100 differentially labeled particles. The particles may be externally labeled, such as with a tag, or they may be intrinsically labeled. Each differentially labeled particle can be coupled to a capture agent, such as a binding agent, for a vesicle, resulting in capture of a vesicle. The multiple capture agents can be selected to characterize a phenotype of interest, including capture agents against general vesicle biomarkers, cell-of-origin specific biomarkers, and disease biomarkers. One or more biomarkers of the captured vesicle can then be detected by a plurality of binding agents. The binding agent can be directly labeled to facilitate detection. Alternatively, the binding agent is labeled by a secondary agent. For example, the binding agent may be an antibody for a biomarker on the vesicle, wherein the binding agent is linked to biotin. A secondary agent comprises streptavidin linked to a reporter and can be added to detect the biomarker. In some embodiments, the captured vesicle is assayed for at least 2, 3, 4, 5, 6, 7, 8, 9, 10, 11, 12, 13, 14, 15, 16, 17, 18, 19, 20, 25, 50, 75 or 100 different biomarkers. For example, multiple detectors, i.e., detection of multiple biomarkers of a captured vesicle or population of vesicles, can increase the signal obtained, permitted increased sensitivity, specificity, or both, and the use of smaller amounts of samples. Detection can be with more than one biomarker, including without limitation more than one general vesicle marker such as in Table 3.

Figure 1B:
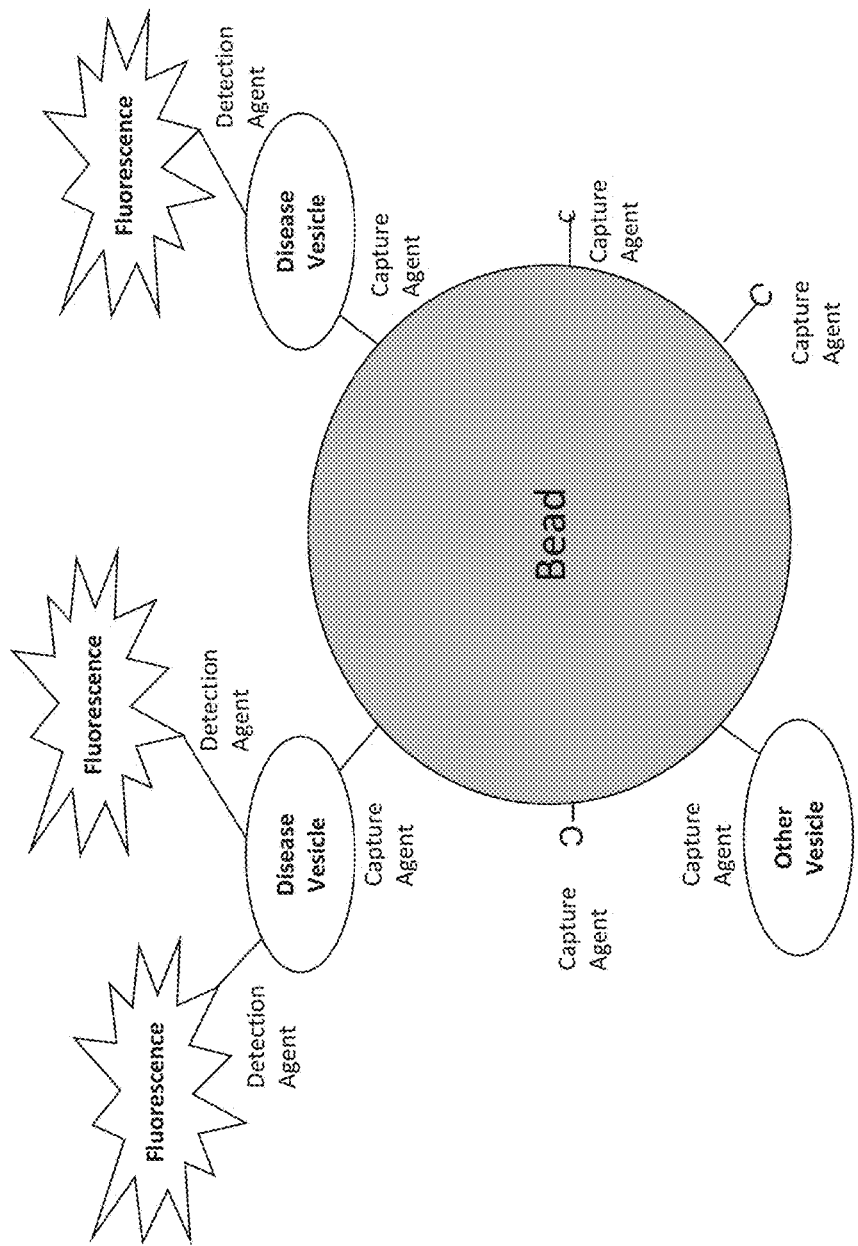

An immunoassay based method (e.g., sandwich assay) can be used to detect a biomarker of a vesicle. An example includes ELISA. A binding agent can be bound to a well. For example, a binding agent such as an aptamer or antibody to an antigen of a vesicle can be attached to a well. A biomarker on the captured vesicle can be detected based on the methods described herein. FIG. 1A shows an illustrative schematic for a sandwich-type of immunoassay. The capture agent can be against a vesicle antigen of interest, e.g., a general vesicle biomarker, a cell-of-origin marker, or a disease marker. In the figure, the captured vesicles are detected using fluorescently labeled binding agent (detection agent) against vesicle antigens of interest. Multiple capture binding agents can be used, e.g., in distinguishable addresses on an array or different wells of an immunoassay plate. The detection binding agents can be against the same antigen as the capture binding agent, or can be directed against other markers. The capture binding agent can be any useful binding agent, e.g., tethered aptamers, antibodies or lectins, and/or the detector antibodies can be similarly substituted, e.g., with detectable (e.g., labeled) aptamers, antibodies, lectins or other binding proteins or entities. In an embodiment, one or more capture agents to a general vesicle biomarker, a cell-of-origin marker, and/or a disease marker are used along with detection agents against general vesicle biomarker, such as tetraspanin molecules including without limitation one or more of CD9, CD63 and CD81, or other markers in Table 3 herein. Examples of microvesicle surface antigens are disclosed herein, e.g. in Tables 3 or 4, or are known in the art, and examples useful in methods and compositions of the invention are disclosed of International Patent Application Serial No. PCT/US2011/031479, entitled "Circulating Biomarkers for Disease" and filed Apr. 6, 2011.

Figure 1D:
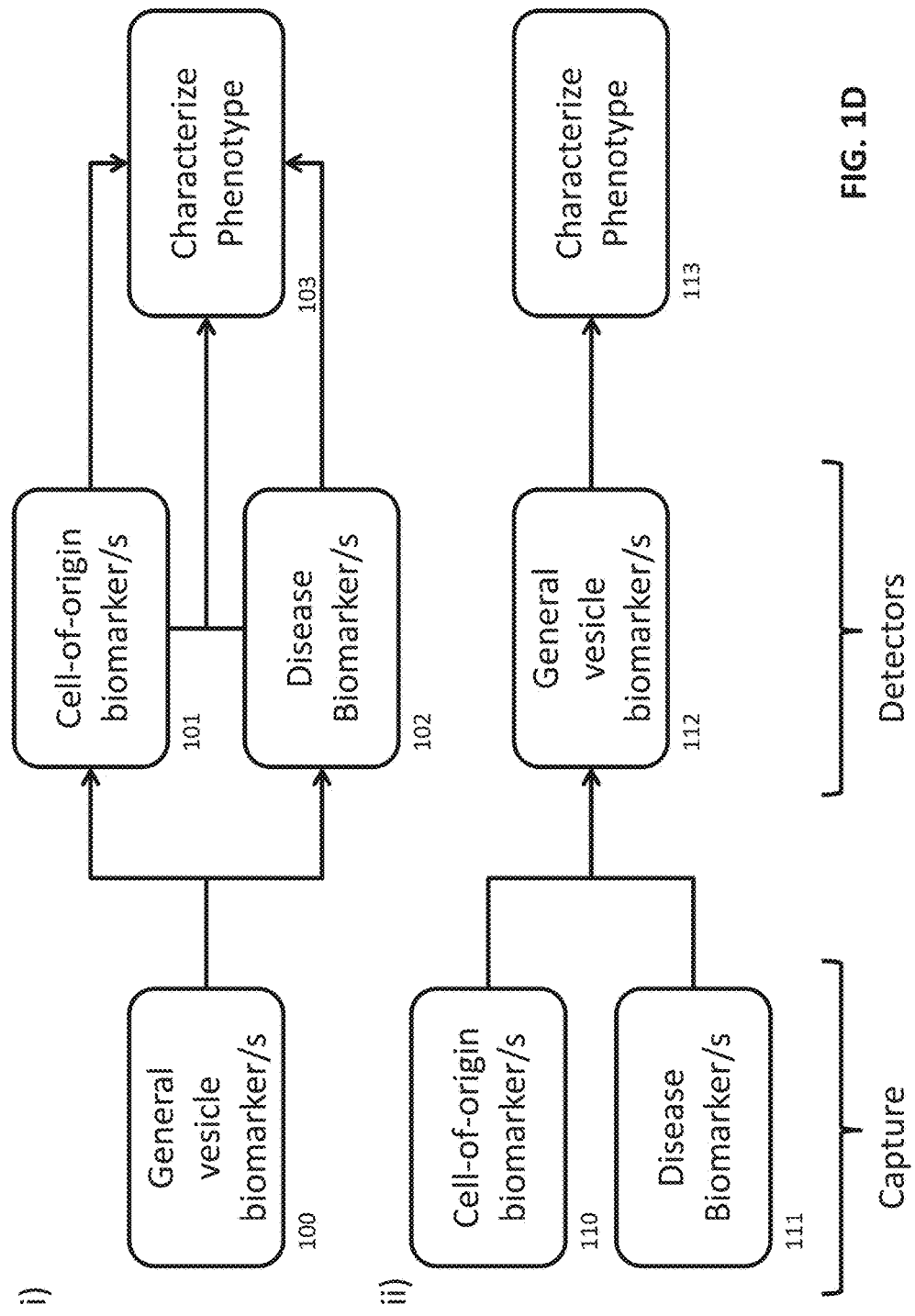

FIG. 1D presents an illustrative schematic for analyzing vesicles according to the methods of the invention. Capture agents are used to capture vesicles, detectors are used to detect the captured vesicles, and the level or presence of the captured and detected microvesicles is used to characterize a phenotype. Capture agents, detectors and characterizing phenotypes can be any of those described herein. For example, capture agents include antibodies or aptamers tethered to a substrate that recognize a vesicle antigen of interest, detectors include labeled antibodies or aptamers to a vesicle antigen of interest, and characterizing a phenotype includes a diagnosis, prognosis, or theranosis of a disease. In the scheme shown in FIG. 1D i), a population of vesicles is captured with one or more capture agents against general vesicle biomarkers (100). The captured vesicles are then labeled with detectors against cell-of-origin biomarkers (101) and/or disease specific biomarkers (102). If only cell-of-origin detectors are used (101), the biosignature used to characterize the phenotype (103) can include the general vesicle markers (100) and the cell-of-origin biomarkers (101). If only disease detectors are used (102), the biosignature used to characterize the phenotype (103) can include the general vesicle markers (100) and the disease biomarkers (102). Alternately, detectors are used to detect both cell-of-origin biomarkers (101) and disease specific biomarkers (102). In this case, the biosignature used to characterize the phenotype (103) can include the general vesicle markers (100), the cell-of-origin biomarkers (101) and the disease biomarkers (102). The biomarkers combinations are selected to characterize the phenotype of interest and can be selected from the biomarkers and phenotypes described herein, e.g., in Tables 3 or 4.

In the scheme shown in FIG. 1D ii), a population of vesicles is captured with one or more capture agents against cell-of-origin biomarkers (110) and/or disease biomarkers (111). The captured vesicles are then detected using detectors against general vesicle biomarkers (112). If only cell-of-origin capture agents are used (110), the biosignature used to characterize the phenotype (113) can include the cell-of-origin biomarkers (110) and the general vesicle markers (112). If only disease biomarker capture agents are used (111), the biosignature used to characterize the phenotype (113) can include the disease biomarkers (111) and the general vesicle biomarkers (112). Alternatively, capture agents to one or more cell-of-origin biomarkers (110) and one or more disease specific biomarkers (111) are used to capture vesicles. In this case, the biosignature used to characterize the phenotype (113) can include the cell-of-origin biomarkers (110), the disease biomarkers (111), and the general vesicle markers (113). The biomarkers combinations are selected to characterize the phenotype of interest and can be selected from the biomarkers and phenotypes described herein.

Figure 1E:
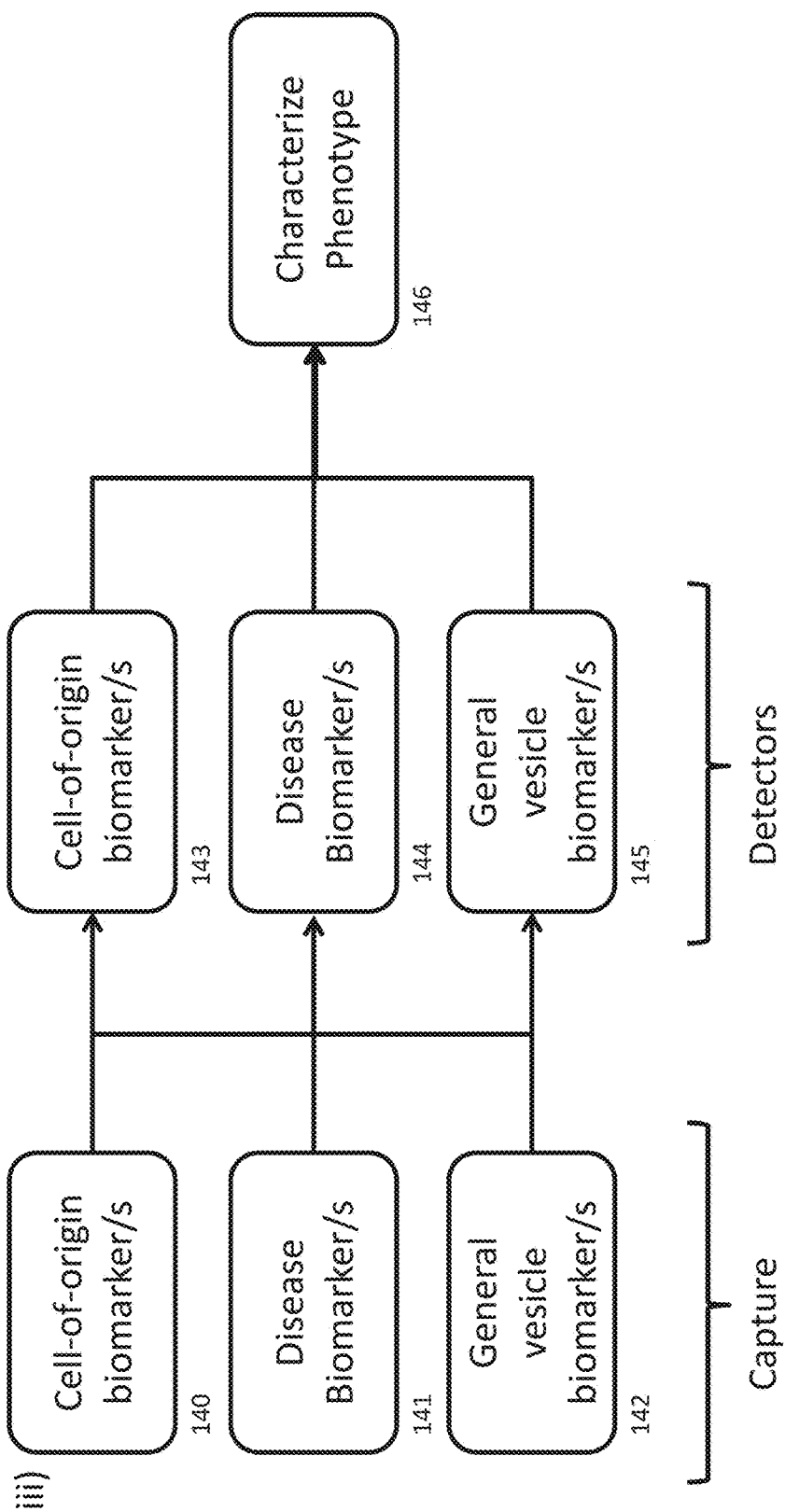
Figure 1F:
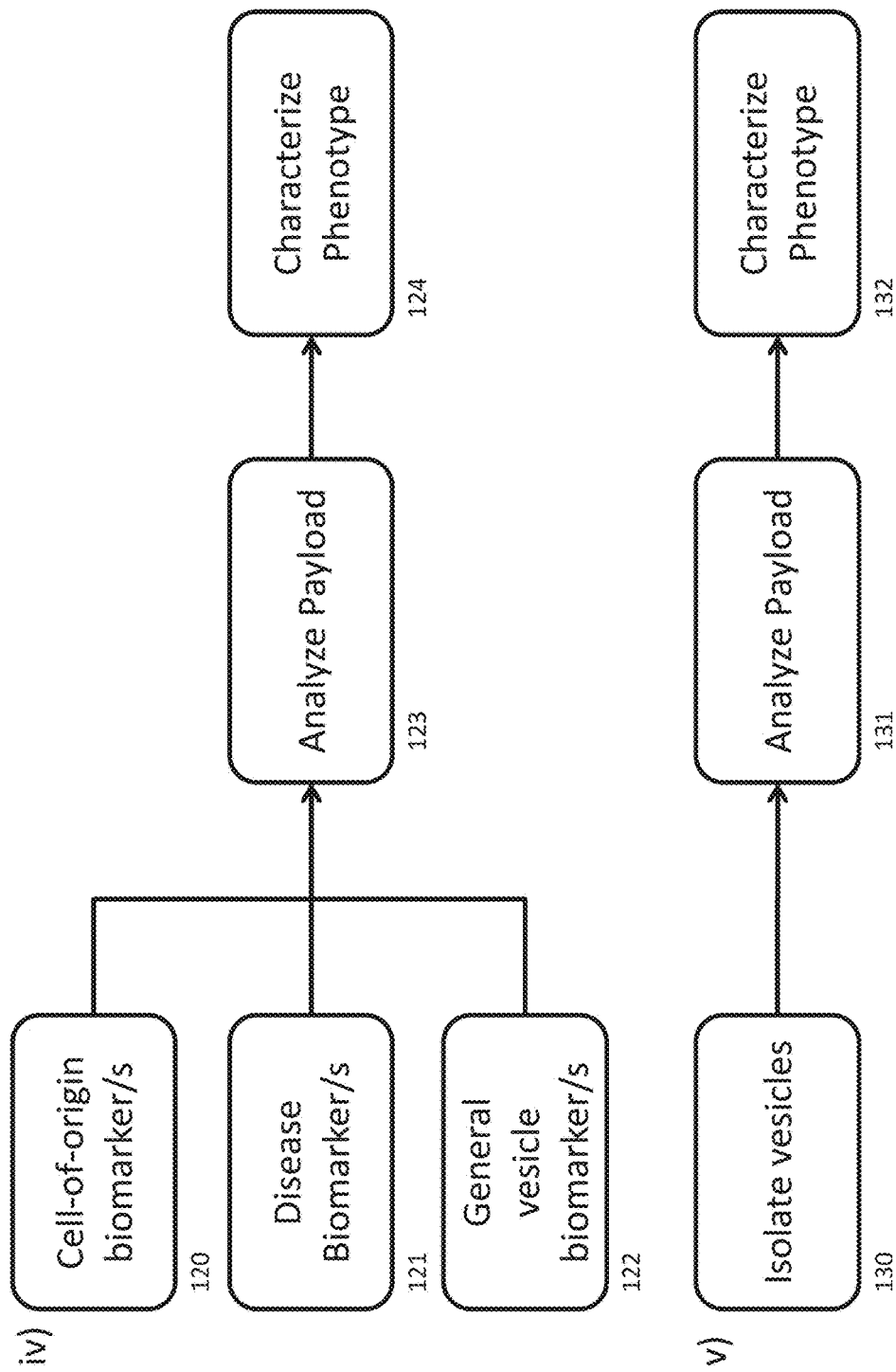

The methods of the invention comprise capture and detection of microvesicles of interest using any combination of useful biomarkers. For example, a microvesicle population can be captured using one or more binding agent to any desired combination of cell of origin, disease specific, or general vesicle markers. The captured microvesicles can then be detected using one or more binding agent to any desired combination of cell of origin, disease specific, or general vesicle markers. FIG. 1E represents a flow diagram of such configurations. Any one or more of a cell-of-origin biomarker (140), disease biomarkers (141), and general vesicle biomarker (142) is used to capture a microvesicle population. Thereafter, any one or more of a cell-of-origin biomarker (143), disease biomarkers (144), and general vesicle biomarker (145) is used to detect the captured microvesicle population. The biosignature of captured and detected microvesicles is then used to characterize a phenotype (146). The biomarkers combinations are selected to characterize the phenotype of interest and can be selected from the biomarkers and phenotypes described herein.

A microvesicle payload molecule can be assessed as a member of a biosignature panel. A payload molecule comprises any of the biological entities contained within a cell, cell fragment or vesicle membrane. These entities include without limitation nucleic acids, e.g., mRNA, microRNA, or DNA fragments; protein, e.g., soluble and membrane associated proteins; carbohydrates; lipids; metabolites; and various small molecules, e.g., hormones. The payload can be part of the cellular milieu that is encapsulated as a vesicle is formed in the cellular environment. In some embodiments of the invention, the payload is analyzed in addition to detecting vesicle surface antigens. Specific populations of vesicles can be captured as described above then the payload in the captured vesicles can be used to characterize a phenotype. For example, vesicles captured on a substrate can be further isolated to assess the payload therein. Alternately, the vesicles in a sample are detected and sorted without capture. The vesicles so detected can be further isolated to assess the payload therein. In an embodiment, vesicle populations are sorted by flow cytometry and the payload in the sorted vesicles is analyzed. In the scheme shown in FIG. 1F iii), a population of vesicles is captured and/or detected (120) using one or more of cell-of-origin biomarkers (120), disease biomarkers (121), and/or general vesicle markers (122). The payload of the isolated vesicles is assessed (123). A biosignature detected within the payload can be used to characterize a phenotype (124). In a non-limiting example, a vesicle population can be analyzed in a plasma sample from a patient using antibodies against one or more vesicle antigens of interest. The antibodies can be capture antibodies which are tethered to a substrate to isolate a desired vesicle population. Alternately, the antibodies can be directly labeled and the labeled vesicles isolated by sorting with flow cytometry. The presence or level of microRNA or mRNA extracted from the isolated vesicle population can be used to detect a biosignature. The biosignature is then used to diagnose, prognose or theranose the patient.

In other embodiments, vesicle or cellular payload is analyzed in a population (e.g., cells or vesicles) without first capturing or detected subpopulations of vesicles. For example, a cellular or extracellular vesicle population can be generally isolated from a sample using centrifugation, filtration, chromatography, or other techniques as described herein and known in the art. The payload of such sample components can be analyzed thereafter to detect a biosignature and characterize a phenotype. In the scheme shown in FIG. 1F v), a population of vesicles is isolated (130) and the payload of the isolated vesicles is assessed (131). A biosignature detected within the payload can be used to characterize a phenotype (132). In a non-limiting example, a vesicle population is isolated from a plasma sample from a patient using size exclusion and membrane filtration. The presence or level of microRNA or mRNA extracted from the vesicle population is used to detect a biosignature. The biosignature is then used to diagnose, prognose or theranose the patient.

The biomarkers used to detect a vesicle population can be selected to detect a microvesicle population of interest, e.g., a population of vesicles that provides a diagnosis, prognosis or theranosis of a selected condition or disease, including but not limited to a cancer, a premalignant condition, an inflammatory disease, an immune disease, an autoimmune disease or disorder, a cardiovascular disease or disorder, neurological disease or disorder, infectious disease or pain. See Section "Phenotypes" herein for more detail. In an embodiment, the biomarkers are selected from the group consisting of EpCam (epithelial cell adhesion molecule), CD9 (tetraspanin CD9 molecule), PCSA (prostate cell specific antigen, see Rokhlin et al., 5E10: a prostate-specific surface-reactive monoclonal antibody. Cancer Lett. 1998 131:129-36), CD63 (tetraspanin CD63 molecule), CD81 (tetraspanin CD81 molecule), PSMA (FOLH1, folate hydrolase (prostate-specific membrane antigen) 1), B7H3 (CD276 molecule), PSCA (prostate stem cell antigen), ICAM (intercellular adhesion molecule), STEAP (STEAP1, six transmembrane epithelial antigen of the prostate 1), KLK2 (kallikrein-related peptidase 2), SSX2 (synovial sarcoma, X breakpoint 2), SSX4 (synovial sarcoma, X breakpoint 4), PBP (prostatic binding protein), SPDEF (SAM pointed domain containing ets transcription factor), EGFR (epidermal growth factor receptor), and a combination thereof. One or more of these markers can provide a biosignature for a specific condition, such as to detect a cancer, including without limitation a carcinoma, a prostate cancer, a breast cancer, a lung cancer, a colorectal cancer, an ovarian cancer, melanoma, a brain cancer, or other type of cancer as disclosed herein. In an embodiment, a binding agent to one or more of these markers is used to capture a microvesicle population, and an aptamer of the invention is used to assist in detection of the capture vesicles as described herein. In other embodiments, an aptamer of the invention is used to capture a microvesicle population, and a binding agent to one or more of these markers is used to assist in detection of the capture vesicles as described herein. The binding agents can be any useful binding agent as disclosed herein or known in the art, e.g., antibodies or aptamers.

The methods of characterizing a phenotype can employ a combination of techniques to assess a component or population of components present in a biological sample of interest. For example, an aptamer of the invention can be used to assess a single cell, or a single extracellular vesicle or a population of cells or population of vesicles. A sample may be split into various aliquots, where each is analyzed separately. For example, protein content of one or more aliquot is determined and microRNA content of one or more other aliquot is determined. The protein content and microRNA content can be combined to characterize a phenotype. In another embodiment, a component present in a biological sample of interest is isolated and the payload therein is assessed (e.g., capture a population of subpopulation of vesicles using an aptamer of the invention and further assess nucleic acid or proteins present in the isolated vesicles).

In one embodiment, a population of vesicles with a given surface marker can be isolated by using a binding agent to a microvesicle surface marker. See, e.g., FIGS. 1A, 1B, 15A. The binding agent can be an aptamer that was identified to target the microvesicle surface marker using to the methods of the invention. The isolated vesicles is assessed for additional biomarkers such as surface content or payload, which can be contemporaneous to detection of the aptamer-specific target or the assessment of additional biomarkers can be before or subsequent to aptamer-specific target detection.

A biosignature can be detected qualitatively or quantitatively by detecting a presence, level or concentration of a circulating biomarker, e.g., a microRNA, protein, vesicle or other biomarker, as disclosed herein. These biosignature components can be detected using a number of techniques known to those of skill in the art. For example, a biomarker can be detected by microarray analysis, polymerase chain reaction (PCR) (including PCR-based methods such as real time polymerase chain reaction (RT-PCR), quantitative real time polymerase chain reaction (Q-PCR/qPCR) and the like), hybridization with allele-specific probes, enzymatic mutation detection, ligation chain reaction (LCR), oligonucleotide ligation assay (OLA), flow-cytometric heteroduplex analysis, chemical cleavage of mismatches, mass spectrometry, nucleic acid sequencing, single strand conformation polymorphism (SSCP), denaturing gradient gel electrophoresis (DGGE), temperature gradient gel electrophoresis (TGGE), restriction fragment polymorphisms, serial analysis of gene expression (SAGE), or combinations thereof. A biomarker, such as a nucleic acid, can be amplified prior to detection. A biomarker can also be detected by immunoassay, immunoblot, immunoprecipitation, enzyme-linked immunosorbent assay (ELISA; EIA), radioimmunoassay (RIA), flow cytometry, or electron microscopy (EM).

Biosignatures can be detected using aptamers of the invention that function as either as capture agents and detection agents, as described herein. A capture agent can comprise an antibody, aptamer or other entity which recognizes a biomarker and can be used for capturing the biomarker. Biomarkers that can be captured include circulating biomarkers, e.g., a protein, nucleic acid, lipid or biological complex in solution in a bodily fluid. Similarly, the capture agent can be used for capturing a vesicle. A detection agent can comprise an antibody or other entity which recognizes a biomarker and can be used for detecting the biomarker vesicle, or which recognizes a vesicle and is useful for detecting a vesicle. In some embodiments, the detection agent is labeled and the label is detected, thereby detecting the biomarker or vesicle. The detection agent can be a binding agent, e.g., an antibody or aptamer. In other embodiments, the detection agent comprises a small molecule such as a membrane protein labeling agent. See, e.g., the membrane protein labeling agents disclosed in Alroy et al., US. Patent Publication US 2005/0158708. In an embodiment, vesicles are isolated or captured as described herein, and one or more membrane protein labeling agent is used to detect the vesicles. In many cases, the antigen or other vesicle-moiety that is recognized by the capture and detection agents are interchangeable.

In a non-limiting embodiment, a vesicle having a cell-of-origin specific antigen on its surface and a cancer-specific antigen on its surface, is captured using a binding agent that is specific to a cells-specific antigen, e.g., by tethering the capture antibody or aptamer to a substrate, and then the vesicle is detected using a binding agent to a disease-specific antigen, e.g., by labeling the binding agent used for detection with a fluorescent dye and detecting the fluorescent radiation emitted by the dye.

It will be apparent to one of skill in the art that where the target molecule for a binding agent (such as an aptamer of the invention) is informative as to assessing a condition or disease, the same binding agent can be used to both capture a component comprising the target molecule (e.g., microvesicle surface antigen of interest) and also be modified to comprise a detectable label so as to detect the target molecule, e.g., binding agent$_1$-antigen-binding agent$_2$*, wherein the * signifies a detectable label; binding agent$_1$ and binding agent$_2$ may be the same binding agent or a different binding agent (e.g., same aptamer or different aptamer). In addition, binding agent$_1$ and binding agent$_2$ can be selected from wholly different categories of binding agents (e.g., antibody, aptamer, synthetic antibody, peptide-nucleic acid molecule, or any molecule that is configured to specifically bind to or associate with its target molecule). Such binding molecules can be selected solely based on their binding specificity for a target molecule.

Techniques of detecting biomarkers or capturing sample components using an aptamer of the invention include the use of a planar substrate such as an array (e.g., biochip or microarray), with molecules immobilized to the substrate as capture agents that facilitate the detection of a particular biosignature. The array can be provided as part of a kit for assaying one or more biomarkers. Additional examples of binding agents described above and useful in the compositions and methods of the invention are disclosed in International Patent Application Serial No. PCT/US2011/031479, entitled "Circulating Biomarkers for Disease" and filed Apr. 6, 2011, which application is incorporated by reference in its entirety herein. Aptamers of the invention can be included in an array for detection and diagnosis of diseases including presymptomatic diseases. In some embodiments, an array comprises a custom array comprising biomolecules selected to specifically identify biomarkers of interest. Customized arrays can be modified to detect biomarkers that increase statistical performance, e.g., additional biomolecules that identifies a biosignature which lead to improved cross-validated error rates in multivariate prediction models (e.g., logistic regression, discriminant analysis, or regression tree models). In some embodiments, customized array(s) are constructed to study the biology of a disease, condition or syndrome and profile biosignatures in defined physiological states. Markers for inclusion on the customized array be chosen based upon statistical criteria, e.g., having a desired level of statistical significance in differentiating between phenotypes or physiological states. In some embodiments, standard significance of p-value=0.05 is chosen to exclude or include biomolecules on the microarray. The p-values can be corrected for multiple comparisons. As an illustrative example, nucleic acids extracted from samples from a subject with or without a disease can be hybridized to a high density microarray that binds to thousands of gene sequences. Nucleic acids whose levels are significantly different between the samples with or without the disease can be selected as biomarkers to distinguish samples as having the disease or not. A customized array can be constructed to detect the selected biomarkers.

In some embodiments, customized arrays comprise low density microarrays, which refer to arrays with lower number of addressable binding agents, e.g., tens or hundreds instead of thousands. Low density arrays can be formed on a substrate. In some embodiments, customizable low density arrays use PCR amplification in plate wells, e.g., TaqMan® Gene Expression Assays (Applied Biosystems by Life Technologies Corporation, Carlsbad, Calif.).

An aptamer of the invention or other useful binding agent may be linked directly or indirectly to a solid surface or substrate. See, e.g., FIGS. 1A-1B, 14, 15A. A solid surface or substrate can be any physically separable solid to which a binding agent can be directly or indirectly attached including, but not limited to, surfaces provided by microarrays and wells, particles such as beads, columns, optical fibers, wipes, glass and modified or functionalized glass, quartz, mica, diazotized membranes (paper or nylon), polyformaldehyde, cellulose, cellulose acetate, paper, ceramics, metals, metalloids, semiconductive materials, quantum dots, coated beads or particles, other chromatographic materials, magnetic particles; plastics (including acrylics, polystyrene, copolymers of styrene or other materials, polypropylene, polyethylene, polybutylene, polyurethanes, Teflon material, etc.), polysaccharides, nylon or nitrocellulose, resins, silica or silica-based materials including silicon and modified silicon, carbon, metals, inorganic glasses, plastics, ceramics, conducting polymers (including polymers such as polypyrole and polyindole); micro or nanostructured surfaces such as nucleic acid tiling arrays, nanotube, nanowire, or nanoparticulate decorated surfaces; or porous surfaces or gels such as methacrylates, acrylamides, sugar polymers, cellulose, silicates, or other fibrous or stranded polymers. In addition, as is known the art, the substrate may be coated using passive or chemically-derivatized coatings with any number of materials, including polymers, such as dextrans, acrylamides, gelatins or agarose. Such coatings can facilitate the use of the array with a biological sample.

As provided in the examples, below, an aptamer or other useful binding agent can be conjugated to a detectable entity or label. Appropriate labels include without limitation a magnetic label, a fluorescent moiety, an enzyme, a chemiluminescent probe, a metal particle, a non-metal colloidal particle, a polymeric dye particle, a pigment molecule, a pigment particle, an electrochemically active species, semiconductor nanocrystal or other nanoparticles including quantum dots or gold particles, fluorophores, quantum dots, or radioactive labels. Protein labels include green fluorescent protein (GFP) and variants thereof (e.g., cyan fluorescent protein and yellow fluorescent protein); and luminescent proteins such as luciferase, as described below. Radioactive labels include without limitation radioisotopes (radionuclides), such as $^3$H, $^{11}$C, $^{14}$C, $^{18}$F, $^{32}$P, $^{35}$S, $^{64}$Cu, $^{68}$Ga, $^{86}$Y, $^{99}$Tc, $^{111}$In, $^{123}$I, $^{124}$I, $^{125}$I, $^{131}$I, $^{133}$Xe, $^{177}$Lu, $^{211}$At, or $^{213}$Bi. Fluorescent labels include without limitation a rare earth chelate (e.g., europium chelate), rhodamine; fluorescein types including without limitation FITC, 5-carboxyfluorescein, 6-carboxy fluorescein; a rhodamine type including without limitation TAMRA; dansyl; Lissamine; cyanines; phycoerythrins; Texas Red; Cy3, Cy5, dapoxyl, NBD, Cascade Yellow, dansyl, PyMPO, pyrene, 7-diethyl-aminocoumarin-3-carboxylic acid and other coumarin derivatives, Marina Blue™, Pacific Blue™, Cascade Blue™, 2-anthracenesulfonyl, PyMPO, 3,4,9,10-perylene-tetracarboxylic acid, 2,7-difluorofluorescein (Oregon Green™ 488-X), 5-carboxyfluorescein, Texas Red™-X, Alexa Fluor 430, 5-carboxytetramethylrhodamine (5-TAMRA), 6-carboxytetramethylrhodamine (6-TAMRA), BODIPY FL, bimane, and Alexa Fluor 350, 405, 488, 500, 514, 532, 546, 555, 568, 594, 610, 633, 647, 660, 680, 700, and 750, and derivatives thereof, among many others. See, e.g., "The Handbook—A Guide to Fluorescent Probes and Labeling Technologies," Tenth Edition, available on the internet at probes (dot) invitrogen (dot) com/handbook. The fluorescent label can be one or more of FAM, dRHO, 5-FAM, 6FAM, dR6G, JOE, HEX, VIC, TET, dTAMRA, TAMRA, NED, dROX, PET, BHQ, Gold540 and LIZ.

Using conventional techniques, an aptamer can be directly or indirectly labeled, e.g., the label is attached to the aptamer through biotin-streptavidin (e.g., synthesize a biotinylated aptamer, which is then capable of binding a streptavidin molecule that is itself conjugated to a detectable label; non-limiting example is streptavidin, phycoerythrin conjugated (SAPE)). Methods for chemical coupling using multiple step procedures include biotinylation, coupling of trinitrophenol (TNP) or digoxigenin using for example succinimide esters of these compounds. Biotinylation can be accomplished by, for example, the use of D-biotinyl-N-hydroxysuccinimide. Succinimide groups react effectively with amino groups at pH values above 7, and preferentially between about pH 8.0 and about pH 8.5. Alternatively, an aptamer is not labeled, but is later contacted with a second antibody that is labeled after the first antibody is bound to an antigen of interest.

Various enzyme-substrate labels may also be used in conjunction with a composition or method of the invention. Such enzyme-substrate labels are available commercially (e.g., U.S. Pat. No. 4,275,149). The enzyme generally catalyzes a chemical alteration of a chromogenic substrate that can be measured using various techniques. For example, the enzyme may catalyze a color change in a substrate, which can be measured spectrophotometrically. Alternatively, the enzyme may alter the fluorescence or chemiluminescence of the substrate. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRP), alkaline phosphatase (AP), β-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Examples of enzyme-substrate combinations include, but are not limited to, horseradish peroxidase (HRP) with hydrogen peroxidase as a substrate, wherein the hydrogen peroxidase oxidizes a dye precursor (e.g., orthophenylene diamine (OPD) or 3,3',5,5'-tetramethylbenzidine hydrochloride (TMB)); alkaline phosphatase (AP) with para-nitrophenyl phosphate as chromogenic substrate; and β-D-galactosidase (P1-D-Gal) with a chromogenic substrate (e.g., p-nitrophenyl-β-D-galactosidase) or fluorogenic substrate 4-methylumbelliferyl-β-D-galactosidase.

Aptamer(s) can be linked to a substrate such as a planar substrate. A planar array generally contains addressable locations (e.g., pads, addresses, or micro-locations) of biomolecules in an array format. The size of the array will depend on the composition and end use of the array. Arrays can be made containing from 2 different molecules to many thousands. Generally, the array comprises from two to as many as 100,000 or more molecules, depending on the end use of the array and the method of manufacture. A microarray for use with the invention comprises at least one biomolecule that identifies or captures a biomarker present in a biosignature of interest, e.g., a microRNA or other biomolecule or vesicle that makes up the biosignature. In some arrays, multiple substrates are used, either of different or identical compositions. Accordingly, planar arrays may comprise a plurality of smaller substrates.

The present invention can make use of many types of arrays for detecting a biomarker, e.g., a biomarker associated with a biosignature of interest. Useful arrays or microarrays include without limitation DNA microarrays, such as cDNA microarrays, oligonucleotide microarrays and SNP microarrays, microRNA arrays, protein microarrays, antibody microarrays, tissue microarrays, cellular microarrays (also called transfection microarrays), chemical compound microarrays, and carbohydrate arrays (glycoarrays). These arrays are described in more detail above. In some embodiments, microarrays comprise biochips that provide high-density immobilized arrays of recognition molecules (e.g., aptamers or antibodies), where biomarker binding is monitored indirectly (e.g., via fluorescence).

An array or microarray that can be used to detect one or more biomarkers of a biosignature and comprising one or more aptamers can be made according to the methods described in U.S. Pat. Nos. 6,329,209; 6,365,418; 6,406,921; 6,475,808; and 6,475,809, and U.S. patent application Ser. No. 10/884,269, each of which is herein incorporated by reference in its entirety. Custom arrays to detect specific selections of sets of biomarkers described herein can be made using the methods described in these patents. Commercially available microarrays can also be used to carry out the methods of the invention, including without limitation those from Affymetrix (Santa Clara, Calif.), Illumina (San Diego, Calif.), Agilent (Santa Clara, Calif.), Exiqon (Denmark), or Invitrogen (Carlsbad, Calif.). Custom and/or commercial arrays include arrays for detection proteins, nucleic acids, and other biological molecules and entities (e.g., cells, vesicles, virii) as described herein.

In some embodiments, multiple capture molecules are disposed on an array, e.g., proteins, peptides or additional nucleic acid molecules. In certain embodiments, the proteins are immobilized using methods and materials that minimize the denaturing of the proteins, that minimize alterations in the activity of the proteins, or that minimize interactions between the protein and the surface on which they are immobilized. The capture molecules can comprise one or more aptamer of the invention. In one embodiment, an array is constructed for the hybridization of a pool of aptamers. The array can then be used to identify pool members that bind a sample, thereby facilitating characterization of a phenotype. See FIGS. 15B-15C and related disclosure for further details.

Array surfaces useful may be of any desired shape, form, or size. Non-limiting examples of surfaces include chips, continuous surfaces, curved surfaces, flexible surfaces, films, plates, sheets, or tubes. Surfaces can have areas ranging from approximately a square micron to approximately 500 cm$^2$. The area, length, and width of surfaces may be varied according to the requirements of the assay to be performed. Considerations may include, for example, ease of handling, limitations of the material(s) of which the surface is formed, requirements of detection systems, requirements of deposition systems (e.g., arrayers), or the like.

In certain embodiments, it is desirable to employ a physical means for separating groups or arrays of binding islands or immobilized biomolecules: such physical separation facilitates exposure of different groups or arrays to different solutions of interest. Therefore, in certain embodiments, arrays are situated within microwell plates having any number of wells. In such embodiments, the bottoms of the wells may serve as surfaces for the formation of arrays, or arrays may be formed on other surfaces and then placed into wells. In certain embodiments, such as where a surface without wells is used, binding islands may be formed or molecules may be immobilized on a surface and a gasket having holes spatially arranged so that they correspond to the islands or biomolecules may be placed on the surface. Such a gasket is preferably liquid tight. A gasket may be placed on a surface at any time during the process of making the array and may be removed if separation of groups or arrays is no longer necessary.

In some embodiments, the immobilized molecules can bind to one or more biomarkers or vesicles present in a biological sample contacting the immobilized molecules. In some embodiments, the immobilized molecules modify or are modified by molecules present in the one or more vesicles contacting the immobilized molecules. Contacting the sample typically comprises overlaying the sample upon the array.

Modifications or binding of molecules in solution or immobilized on an array can be detected using detection techniques known in the art. Examples of such techniques include immunological techniques such as competitive binding assays and sandwich assays; fluorescence detection using instruments such as confocal scanners, confocal microscopes, or CCD-based systems and techniques such as fluorescence, fluorescence polarization (FP), fluorescence resonant energy transfer (FRET), total internal reflection fluorescence (TIRF), fluorescence correlation spectroscopy (FCS); colorimetric/spectrometric techniques; surface plasmon resonance, by which changes in mass of materials adsorbed at surfaces are measured; techniques using radioisotopes, including conventional radioisotope binding and scintillation proximity assays (SPA); mass spectroscopy, such as matrix-assisted laser desorption/ionization mass spectroscopy (MALDI) and MALDI-time of flight (TOF) mass spectroscopy; ellipsometry, which is an optical method of measuring thickness of protein films; quartz crystal microbalance (QCM), a very sensitive method for measuring mass of materials adsorbing to surfaces; scanning probe microscopies, such as atomic force microscopy (AFM), scanning force microscopy (SFM) or scanning electron microscopy (SEM); and techniques such as electrochemical, impedance, acoustic, microwave, and IR/Raman detection. See, e.g., Mere L, et al., "*Miniaturized FRET assays and microfluidics: key components for ultra-high-throughput screening,*" Drug Discovery Today 4(8):363-369 (1999), and references cited therein; Lakowicz J R, *Principles of Fluorescence Spectroscopy*, 2nd Edition, Plenum Press (1999), or Jain K K: *Integrative Omics, Pharmacoproteomics, and Human Body Fluids. In: Thongboonkerd V ed., ed. Proteomics of Human Body Fluids: Principles, Methods and Applications.* Volume 1: Totowa, N.J.: Humana Press, 2007, each of which is herein incorporated by reference in its entirety.

Microarray technology can be combined with mass spectroscopy (MS) analysis and other tools. Electrospray interface to a mass spectrometer can be integrated with a capillary in a microfluidics device. For example, one commercially available system contains eTag reporters that are fluorescent labels with unique and well-defined electrophoretic mobilities; each label is coupled to biological or chemical probes via cleavable linkages. The distinct mobility address of each eTag reporter allows mixtures of these tags to be rapidly deconvoluted and quantitated by capillary electrophoresis. This system allows concurrent gene expression, protein expression, and protein function analyses from the same sample Jain K K: *Integrative Omics, Pharmacoproteomics, and Human Body Fluids.* In: Thongboonkerd V, ed., ed. *Proteomics of Human Body Fluids: Principles, Methods and Applications.* Volume 1: Totowa, N.J.: Humana Press, 2007, which is herein incorporated by reference in its entirety.

A biochip can include components for a microfluidic or nanofluidic assay. A microfluidic device can be used for isolating or analyzing biomarkers, such as determining a biosignature. Microfluidic systems allow for the miniaturization and compartmentalization of one or more processes for isolating, capturing or detecting a vesicle, detecting a microRNA, detecting a circulating biomarker, detecting a biosignature, and other processes. The microfluidic devices can use one or more detection reagents in at least one aspect of the system, and such a detection reagent can be used to detect one or more biomarkers. In one embodiment, the device detects a biomarker on an isolated or bound vesicle. Various probes, antibodies, proteins, or other binding agents can be used to detect a biomarker within the microfluidic system. The detection agents may be immobilized in different compartments of the microfluidic device or be entered into a hybridization or detection reaction through various channels of the device.

A vesicle in a microfluidic device can be lysed and its contents detected within the microfluidic device, such as proteins or nucleic acids, e.g., DNA or RNA such as miRNA or mRNA. The nucleic acid may be amplified prior to detection, or directly detected, within the microfluidic device. Thus microfluidic system can also be used for multiplexing detection of various biomarkers. In an embodiment, vesicles are captured within the microfluidic device, the captured vesicles are lysed, and a biosignature of microRNA from the vesicle payload is determined. The biosignature can further comprise the capture agent used to capture the vesicle.

Novel nanofabrication techniques are opening up the possibilities for biosensing applications that rely on fabrication of high-density, precision arrays, e.g., nucleotide-based chips and protein arrays otherwise known as heterogeneous nanoarrays. Nanofluidics allows a further reduction in the quantity of fluid analyte in a microchip to nanoliter levels, and the chips used here are referred to as nanochips. See, e.g., Unger M et al., *Biotechniques* 1999; 27(5):1008-14, Kartalov E P et al., *Biotechniques* 2006; 40(1):85-90, each of which are herein incorporated by reference in their entireties. Commercially available nanochips currently provide simple one step assays such as total cholesterol, total protein or glucose assays that can be run by combining sample and reagents, mixing and monitoring of the reaction. Gel-free analytical approaches based on liquid chromatography (LC) and nanoLC separations (Cutillas et al. *Proteomics,* 2005; 5:101-112 and Cutillas et al., *Mol Cell Proteomics* 2005; 4:1038-1051, each of which is herein incorporated by reference in its entirety) can be used in combination with the nanochips.

An array suitable for identifying a disease, condition, syndrome or physiological status can be included in a kit. A kit can include, an aptamer of the invention, including as non-limiting examples, one or more reagents useful for preparing molecules for immobilization onto binding islands or areas of an array, reagents useful for detecting binding of a vesicle to immobilized molecules, and instructions for use.

Further provided herein is a rapid detection device that facilitates the detection of a particular biosignature in a biological sample. The device can integrate biological sample preparation with polymerase chain reaction (PCR) on a chip. The device can facilitate the detection of a particular biosignature of a vesicle in a biological sample, and an example is provided as described in Pipper et al., *Angewandte Chemie,* 47(21), p. 3900-3904 (2008), which is herein incorporated by reference in its entirety. A biosignature can be incorporated using micro-/nano-electrochemical system (MEMS/NEMS) sensors and oral fluid for diagnostic applications as described in Li et al., *Adv Dent Res* 18(1): 3-5 (2005), which is herein incorporated by reference in its entirety.

In addition to acting as binding agents for a target of interest in an assay, certain aptamers of the invention, e.g., functional group binding aptamers and/or blocking aptamers, can be used to enhance the performance of various biomarker detection techniques disclosed herein or known in the art. As described further below, such aptamers can be used in an assay that makes use of a substrate, wherein the aptamers mitigate non-specific binding to the substrate.

Particle Assays

As an alternative to planar arrays, assays using particles or microspheres, such as bead based assays are also capable of use with an aptamer of the invention. Binding agents such as aptamers and antibodies are easily conjugated with commercially available beads. See, e.g., Srinivas et al. Anal. Chem. 2011 Oct. 21, *Aptamer functionalized Microgel Particles for Protein Detection*; See also, review article on aptamers as therapeutic and diagnostic agents, Brody and Gold, Rev. Mol. Biotech. 2000, 74:5-13.

Multiparametric assays or other high throughput detection assays using bead coatings with cognate ligands and reporter molecules with specific activities consistent with high sensitivity automation can be used. In a bead based assay system, a binding agent for a biomarker or vesicle, such as a capture agent (e.g. capture antibody), can be immobilized on an addressable microsphere. Each binding agent for each individual binding assay can be coupled to a distinct type of microsphere (i.e., microbead) and the assay reaction takes place on the surface of the microsphere, such as depicted in FIG. 1B. A binding agent for a vesicle can be a capture antibody coupled to a bead. Dyed microspheres with discrete fluorescence intensities are loaded separately with their appropriate binding agent or capture probes. The different bead sets carrying different binding agents can be pooled as necessary to generate custom bead arrays. Bead arrays are then incubated with the sample in a single reaction vessel to perform the assay. In some embodiments of the invention, microvesicles are directly conjugated to beads. See, e.g., FIGS. 7A-7D. The bead conjugated vesicles can be used to enrich for aptamers the bind the microvesicles. See Examples 28-33.

Bead-based assays can also be used with one or more aptamers of the invention. A bead substrate can provide a platform for attaching one or more binding agents, including aptamer(s). For multiplexing, multiple different bead sets (e.g., Illumina, Luminex) can have different binding agents (specific to different target molecules). For example, a bead can be conjugated to a binding agent, e.g., an aptamer of the invention, used to detect the presence (quantitatively or qualitatively) of an antigen of interest, or it can also be used to isolate a component present in a selected biological sample (e.g., cell, cell-fragment or vesicle comprising the target molecule to which the aptamer is configured to bind or associate). Any molecule of organic origin can be successfully conjugated to a polystyrene bead through use of commercially available kits.

One or more aptamers of the invention can be used with any bead based substrate, including but not limited to magnetic capture method, fluorescence activated cell sorting (FACS) or laser cytometry. Magnetic capture methods can include, but are not limited to, the use of magnetically activated cell sorter (MACS) microbeads or magnetic columns. Examples of bead or particle based methods that can be modified to use an aptamer of the invention include methods and bead systems described in U.S. Pat. Nos. 4,551,435, 4,795,698, 4,925,788, 5,108,933, 5,186,827, 5,200,084 or U.S. Pat. Nos. 5,158,871; 7,399,632; 8,124,015; 8,008,019; 7,955,802; 7,445,844; 7,274,316; 6,773,812; 6,623,526; 6,599,331; 6,057,107; 5,736,330; international patent application no. PCT/US2012/42519; PCT/US1993/04145.

Flow Cytometry

Isolation or detection of circulating biomarkers, e.g., protein antigens, from a biological sample, or of the biomarker-comprising cells, cell fragments or vesicles may also be achieved using an aptamer of the invention in a cytometry process. As a non-limiting example, aptamers of the invention can be used in an assay comprising using a particle such as a bead or microsphere The invention provides aptamers as binding agents, which may be conjugated to the particle. Flow cytometry can be used for sorting microscopic particles suspended in a stream of fluid. As particles pass through they can be selectively charged and on their exit can be deflected into separate paths of flow. It is therefore possible to separate populations from an original mix, such as a biological sample, with a high degree of accuracy and speed. Flow cytometry allows simultaneous multiparametric analysis of the physical and/or chemical characteristics of single cells flowing through an optical/electronic detection apparatus. A beam of light, usually laser light, of a single frequency (color) is directed onto a hydrodynamically focused stream of fluid. A number of detectors are aimed at the point where the stream passes through the light beam; one in line with the light beam (Forward Scatter or FSC) and several perpendicular to it (Side Scatter or SSC) and one or more fluorescent detectors.

Each suspended particle passing through the beam scatters the light in some way, and fluorescent chemicals in the particle may be excited into emitting light at a lower frequency than the light source. This combination of scattered and fluorescent light is picked up by the detectors, and by analyzing fluctuations in brightness at each detector (one for each fluorescent emission peak), it is possible to deduce various facts about the physical and chemical structure of each individual particle. FSC correlates with the cell size and SSC depends on the inner complexity of the particle, such as shape of the nucleus, the amount and type of cytoplasmic granules or the membrane roughness. Some flow cytometers have eliminated the need for fluorescence and use only light scatter for measurement.

Flow cytometers can analyze several thousand particles every second in "real time" and can actively separate out and isolate particles having specified properties. They offer high-throughput automated quantification, and separation, of the set parameters for a high number of single cells during each analysis session. Flow cytometers can have multiple lasers and fluorescence detectors, allowing multiple labels to be used to more precisely specify a target population by their phenotype. Thus, a flow cytometer, such as a multicolor flow cytometer, can be used to detect one or more vesicles with multiple fluorescent labels or colors. In some embodiments, the flow cytometer can also sort or isolate different vesicle populations, such as by size or by different markers.

The flow cytometer may have one or more lasers, such as 1, 2, 3, 4, 5, 6, 7, 8, 9, 10 or more lasers. In some embodiments, the flow cytometer can detect more than one color or fluorescent label, such as at least 2, 3, 4, 5, 6, 7, 8, 9, 10, 11, 12, 13, 14, 15, 16, 17, 18, 19, or 20 different colors or fluorescent labels. For example, the flow cytometer can have at least 2, 3, 4, 5, 6, 7, 8, 9, 10, 11, 12, 13, 14, 15, 16, 17, 18, 19, or 20 fluorescence detectors.

Examples of commercially available flow cytometers that can be used to detect or analyze one or more vesicles, to sort or separate different populations of vesicles, include, but are not limited to the MoFlo™ XDP Cell Sorter (Beckman Coulter, Brea, Calif.), MoFlo™ Legacy Cell Sorter (Beckman Coulter, Brea, Calif.), BD FACSAria™ Cell Sorter (BD Biosciences, San Jose, Calif.), BD™ LSRII (BD Biosciences, San Jose, Calif.), and BD FACSCalibur™ (BD Biosciences, San Jose, Calif.). Use of multicolor or multi-fluor cytometers can be used in multiplex analysis of vesicles, as further described below. In some embodiments, the flow cytometer can sort, and thereby collect or sort more than one population of vesicles based one or more characteristics. For example, two populations of vesicles differ in size, such that the vesicles within each population have a similar size range and can be differentially detected or sorted. In another embodiment, two different populations of vesicles are differentially labeled.

The data resulting from flow-cytometers can be plotted in 1 dimension to produce histograms or seen in 2 dimensions as dot plots or in 3 dimensions with newer software. The regions on these plots can be sequentially separated by a series of subset extractions which are termed gates. Specific gating protocols exist for diagnostic and clinical purposes especially in relation to hematology. The plots are often made on logarithmic scales. Because different fluorescent dye's emission spectra overlap, signals at the detectors have to be compensated electronically as well as computationally. Fluorophores for labeling biomarkers may include those described in Ormerod, *Flow Cytometry 2nd ed.*, Springer-Verlag, New York (1999), and in Nida et al., *Gynecologic Oncology* 2005; 4 889-894 which is incorporated herein by reference. In a multiplexed assay, including but not limited to a flow cytometry assay, one or more different target molecules can be assessed. In some embodiments, at least one of the target molecules is a biomarker, e.g., a microvesicle surface antigen, assessed using an aptamer of the invention.

Microfluidics

One or more aptamer of the invention can be conjugated to or otherwise disposed on any useful planar or bead substrate. In one aspect of the invention one or more aptamer of the invention is disposed on a microfluidic device, thereby facilitating assessing, characterizing or isolating a component of a biological sample comprising a polypeptide antigen of interest or a functional fragment thereof. For example, the circulating antigen or a cell, cell fragment or cell-derived vesicles comprising the antigen can be assessed using one or more aptamers of the invention (alternatively along with additional binding agents). Microfluidic devices, which may also be referred to as "lab-on-a-chip" systems, biomedical micro-electro-mechanical systems (bioMEMs), or multicomponent integrated systems, can be used for isolating and analyzing a vesicle. Such systems miniaturize and compartmentalize processes that allow for binding of vesicles, detection of biosignatures, and other processes.

A microfluidic device can also be used for isolation of a vesicle through size differential or affinity selection. For example, a microfluidic device can use one more channels for isolating a vesicle from a biological sample based on size or by using one or more binding agents for isolating a vesicle from a biological sample. A biological sample can be introduced into one or more microfluidic channels, which selectively allows the passage of a vesicle. The selection can be based on a property of the vesicle, such as the size, shape, deformability, or biosignature of the vesicle.

In one embodiment, a heterogeneous population of vesicles can be introduced into a microfluidic device, and one or more different homogeneous populations of vesicles can be obtained. For example, different channels can have different size selections or binding agents to select for different vesicle populations. Thus, a microfluidic device can isolate a plurality of vesicles wherein at least a subset of the plurality of vesicles comprises a different biosignature from another subset of the plurality of vesicles. For example, the microfluidic device can isolate at least 2, 3, 4, 5, 6, 7, 8, 9, 10, 15, 20, 25, 30, 40, 50, 60, 70, 80, 90, or 100 different subsets of vesicles, wherein each subset of vesicles comprises a different biosignature.

In some embodiments, the microfluidic device can comprise one or more channels that permit further enrichment or selection of a vesicle. A population of vesicles that has been enriched after passage through a first channel can be introduced into a second channel, which allows the passage of the desired vesicle or vesicle population to be further enriched, such as through one or more binding agents present in the second channel.

Array-based assays and bead-based assays can be used with microfluidic device. For example, the binding agent can be coupled to beads and the binding reaction between the beads and vesicle can be performed in a microfluidic device. Multiplexing can also be performed using a microfluidic device. Different compartments can comprise different binding agents for different populations of vesicles, where each population is of a different cell-of-origin specific vesicle population. In one embodiment, each population has a different biosignature. The hybridization reaction between the microsphere and vesicle can be performed in a microfluidic device and the reaction mixture can be delivered to a detection device. The detection device, such as a dual or multiple laser detection system can be part of the microfluidic system and can use a laser to identify each bead or microsphere by its color-coding, and another laser can detect the hybridization signal associated with each bead.

Any appropriate microfluidic device can be used in the methods of the invention. Examples of microfluidic devices that may be used, or adapted for use with vesicles, include but are not limited to those described in U.S. Pat. Nos. 7,591,936, 7,581,429, 7,579,136, 7,575,722, 7,568,399, 7,552,741, 7,544,506, 7,541,578, 7,518,726, 7,488,596, 7,485,214, 7,467,928, 7,452,713, 7,452,509, 7,449,096, 7,431,887, 7,422,725, 7,422,669, 7,419,822, 7,419,639, 7,413,709, 7,411,184, 7,402,229, 7,390,463, 7,381,471, 7,357,864, 7,351,592, 7,351,380, 7,338,637, 7,329,391, 7,323,140, 7,261,824, 7,258,837, 7,253,003, 7,238,324, 7,238,255, 7,233,865, 7,229,538, 7,201,881, 7,195,986, 7,189,581, 7,189,580, 7,189,368, 7,141,978, 7,138,062, 7,135,147, 7,125,711, 7,118,910, 7,118,661, 7,640,947, 7,666,361, 7,704,735; and International Patent Publication WO 2010/072410; each of which patents or applications are incorporated herein by reference in their entirety. Another example for use with methods disclosed herein is described in Chen et al., "*Microfluidic isolation and transcriptome analysis of serum vesicles,*" Lab on a Chip, Dec. 8, 2009 DOI: 10.1039/b916199f.

Other microfluidic devices for use with the invention include devices comprising elastomeric layers, valves and pumps, including without limitation those disclosed in U.S. Pat. Nos. 5,376,252, 6,408,878, 6,645,432, 6,719,868, 6,793,753, 6,899,137, 6,929,030, 7,040,338, 7,118,910, 7,144,616, 7,216,671, 7,250,128, 7,494,555, 7,501,245, 7,601,270, 7,691,333, 7,754,010, 7,837,946; U.S. Patent Application Nos. 2003/0061687, 2005/0084421, 2005/0112882, 2005/0129581, 2005/0145496, 2005/0201901, 2005/0214173, 2005/0252773, 2006/0006067; and EP Patent Nos. 0527905 and 1065378; each of which application is herein incorporated by reference. In some instances, much or all of the devices are composed of elastomeric material. Certain devices are designed to conduct thermal cycling reactions (e.g., PCR) with devices that include one or more elastomeric valves to regulate solution flow through the device. The devices can comprise arrays of reaction sites thereby allowing a plurality of reactions to be performed. Thus, the devices can be used to assess circulating microRNAs in a multiplex fashion, including microRNAs isolated from vesicles. In an embodiment, the microfluidic device comprises (a) a first plurality of flow channels formed in an elastomeric substrate; (b) a second plurality of flow channels formed in the elastomeric substrate that intersect the first plurality of flow channels to define an array of reaction sites, each reaction site located at an intersection of one of the first and second flow channels; (c) a plurality of isolation valves disposed along the first and second plurality of flow channels and spaced between the reaction sites that can be actuated to isolate a solution within each of the reaction sites from solutions at other reaction sites, wherein the isolation valves comprise one or more control channels that each overlay and intersect one or more of the flow channels; and (d) means for simultaneously actuating the valves for isolating the reaction sites from each other. Various modifications to the basic structure of the device are envisioned within the scope of the invention. MicroRNAs can be detected in each of the reaction sites by using PCR methods. For example, the method can comprise the steps of the steps of: (i) providing a microfluidic device, the microfluidic device comprising: a first fluidic channel having a first end and a second end in fluid communication with each other through the channel; a plurality of flow channels, each flow channel terminating at a terminal wall; wherein each flow channel branches from and is in fluid communication with the first fluidic channel, wherein an aqueous fluid that enters one of the flow channels from the first fluidic channel can flow out of the flow channel only through the first fluidic channel; and, an inlet in fluid communication with the first fluidic channel, the inlet for introducing a sample fluid; wherein each flow channel is associated with a valve that when closed isolates one end of the flow channel from the first fluidic channel, whereby an isolated reaction site is formed between the valve and the terminal wall; a control channel; wherein each the valve is a deflectable membrane which is deflected into the flow channel associated with the valve when an actuating force is applied to the control channel, thereby closing the valve; and wherein when the actuating force is applied to the control channel a valve in each of the flow channels is closed, so as to produce the isolated reaction site in each flow channel; (ii) introducing the sample fluid into the inlet, the sample fluid filling the flow channels; (iii) actuating the valve to separate the sample fluid into the separate portions within the flow channels; (iv) amplifying the nucleic acid in the sample fluid; (v) analyzing the portions of the sample fluid to determine whether the amplifying produced the reaction. The sample fluid can contain an amplifiable nucleic acid target, e.g., a microRNA, and the conditions can be polymerase chain reaction (PCR) conditions, so that the reaction results in a PCR product being formed.

The microfluidic device can have one or more binding agents attached to a surface in a channel, or present in a channel. For example, the microchannel can have one or more capture agents, such as a capture agent for one or more general microvesicle antigen in Table 3 or a cell-of-origin or cancer related antigen in Table 4, including without limitation EpCam, CD9, PCSA, CD63, CD81, PSMA, B7H3, PSCA, ICAM, STEAP, KLK2, SSX2, SSX4, PBP, SPDEF, and EGFR. The capture agent may be an aptamer selected by the methods of the invention. The surface of the channel can also be contacted with a blocking aptamer of the invention. In one embodiment, a microchannel surface is treated with avidin and a capture agent, such as an antibody, that is biotinylated can be injected into the channel to bind the avidin. In other embodiments, the capture agents are present in chambers or other components of a microfluidic device. The capture agents can also be attached to beads that can be manipulated to move through the microfluidic channels. In one embodiment, the capture agents are attached to magnetic beads. The beads can be manipulated using magnets.

A biological sample can be flowed into the microfluidic device, or a microchannel, at rates such as at least about 1, 2, 3, 4, 5, 6, 7, 8, 9, 10, 11, 12, 13, 14, 15, 16, 17, 18, 19, 20, 25, 30, 35, 40, 45, or 50 µl per minute, such as between about 1-50, 5-40, 5-30, 3-20 or 5-15 µl per minute. One or more vesicles can be captured and directly detected in the microfluidic device. Alternatively, the captured vesicle may be released and exit the microfluidic device prior to analysis. In another embodiment, one or more captured vesicles are lysed in the microchannel and the lysate can be analyzed, e.g., to examine payload within the vesicles. Lysis buffer can be flowed through the channel and lyse the captured vesicles. For example, the lysis buffer can be flowed into the device or microchannel at rates such as at least about a, 2, 3, 4, 5, 6, 7, 8, 9, 10, 11, 12, 13, 14, 15, 16, 17, 18, 19, 20, 25, 26, 27, 28, 29, 30, 35, 40, 45, or 50 µl per minute, such as between about 1-50, 5-40, 10-30, 5-30 or 10-35 µl per minute. The lysate can be collected and analyzed, such as performing RT-PCR, PCR, mass spectrometry, Western blotting, or other assays, to detect one or more biomarkers of the vesicle.

Phenotypes

Disclosed herein are products and processes for characterizing a phenotype using the methods and compositions of the invention. The term "phenotype" as used herein can mean any trait or characteristic that is attributed to a biomarker profile that is identified using in part or in whole the compositions and/or methods of the invention. For example, a phenotype can be a diagnostic, prognostic or theranostic determination based on a characterized biomarker profile for a sample obtained from a subject. A phenotype can be any observable characteristic or trait of, such as a disease or condition, a stage of a disease or condition, susceptibility to a disease or condition, prognosis of a disease stage or condition, a physiological state, or response/potential response to therapeutics. A phenotype can result from a subject's genetic makeup as well as the influence of environmental factors and the interactions between the two, as well as from epigenetic modifications to nucleic acid sequences.

A phenotype in a subject can be characterized by obtaining a biological sample from a subject and analyzing the sample using the compositions and/or methods of the invention. For example, characterizing a phenotype for a subject or individual can include detecting a disease or condition (including pre-symptomatic early stage detecting), determining a prognosis, diagnosis, or theranosis of a disease or condition, or determining the stage or progression of a disease or condition. Characterizing a phenotype can include identifying appropriate treatments or treatment efficacy for specific diseases, conditions, disease stages and condition stages, predictions and likelihood analysis of disease progression, particularly disease recurrence, metastatic spread or disease relapse. A phenotype can also be a clinically distinct type or subtype of a condition or disease, such as a cancer or tumor. Phenotype determination can also be a determination of a physiological condition, or an assessment of organ distress or organ rejection, such as post-transplantation. The compositions and methods described herein allow assessment of a subject on an individual basis, which can provide benefits of more efficient and economical decisions in treatment.

In an aspect, the invention relates to the analysis of biomarkers such as microvesicles to provide a diagnosis, prognosis, and/or theranosis of a disease or condition. Theranostics includes diagnostic testing that provides the ability to affect therapy or treatment of a disease or disease state. Theranostics testing provides a theranosis in a similar manner that diagnostics or prognostic testing provides a diagnosis or prognosis, respectively. As used herein, theranostics encompasses any desired form of therapy related testing, including predictive medicine, personalized medicine, integrated medicine, pharmacodiagnostics and Dx/Rx partnering. Therapy related tests can be used to predict and assess drug response in individual subjects, i.e., to provide personalized medicine. Predicting a drug response can be determining whether a subject is a likely responder or a likely non-responder to a candidate therapeutic agent, e.g., before the subject has been exposed or otherwise treated with the treatment. Assessing a drug response can be monitoring a response to a drug, e.g., monitoring the subject's improvement or lack thereof over a time course after initiating the treatment. Therapy related tests are useful to select a subject for treatment who is particularly likely to benefit from the treatment or to provide an early and objective indication of treatment efficacy in an individual subject. Thus, analysis using the compositions and methods of the invention may indicate that treatment should be altered to select a more promising treatment, thereby avoiding the great expense of delaying beneficial treatment and avoiding the financial and morbidity costs of administering an ineffective drug(s).

Thus, the compositions and methods of the invention may help predict whether a subject is likely to respond to a treatment for a disease or disorder. Characterizating a phenotype includes predicting the responder/non-responder status of the subject, wherein a responder responds to a treatment for a disease and a non-responder does not respond to the treatment. Biomarkers such as microvesicles can be analyzed in the subject and compared against that of previous subjects that were known to respond or not to a treatment. If the biomarker profile in the subject more closely aligns with that of previous subjects that were known to respond to the treatment, the subject can be characterized, or predicted, as a responder to the treatment. Similarly, if the biomarker profile in the subject more closely aligns with that of previous subjects that did not respond to the treatment, the subject can be characterized, or predicted as a non-responder to the treatment. The treatment can be for any appropriate disease, disorder or other condition, including without limitation those disclosed herein.

In some embodiments, the phenotype comprises a disease or condition such as those listed in Table 1. For example, the phenotype can comprise detecting the presence of or likelihood of developing a tumor, neoplasm, or cancer, or characterizing the tumor, neoplasm, or cancer (e.g., stage, grade, aggressiveness, likelihood of metastatis or recurrence, etc). Cancers that can be detected or assessed by methods or compositions described herein include, but are not limited to, breast cancer, ovarian cancer, lung cancer, colon cancer, hyperplastic polyp, adenoma, colorectal cancer, high grade dysplasia, low grade dysplasia, prostatic hyperplasia, prostate cancer, melanoma, pancreatic cancer, brain cancer (such as a glioblastoma), hematological malignancy, hepatocellular carcinoma, cervical cancer, endometrial cancer, head and neck cancer, esophageal cancer, gastrointestinal stromal tumor (GIST), renal cell carcinoma (RCC) or gastric cancer. The colorectal cancer can be CRC Dukes B or Dukes C-D. The hematological malignancy can be B-Cell Chronic Lymphocytic Leukemia, B-Cell Lymphoma-DLBCL, B-Cell Lymphoma-DLBCL-germinal center-like, B-Cell Lymphoma-DLBCL-activated B-cell-like, and Burkitt's lymphoma.

The phenotype can be a premalignant condition, such as actinic keratosis, atrophic gastritis, leukoplakia, erythroplasia, Lymphomatoid Granulomatosis, preleukemia, fibrosis, cervical dysplasia, uterine cervical dysplasia, xeroderma pigmentosum, Barrett's Esophagus, colorectal polyp, or other abnormal tissue growth or lesion that is likely to develop into a malignant tumor. Transformative viral infections such as HIV and HPV also present phenotypes that can be assessed according to the invention.

A cancer characterized by the methods of the invention can comprise, without limitation, a carcinoma, a sarcoma, a lymphoma or leukemia, a germ cell tumor, a blastoma, or other cancers. Carcinomas include without limitation epithelial neoplasms, squamous cell neoplasms squamous cell carcinoma, basal cell neoplasms basal cell carcinoma, transitional cell papillomas and carcinomas, adenomas and adenocarcinomas (glands), adenoma, adenocarcinoma, linitis plastica insulinoma, glucagonoma, gastrinoma, vipoma, cholangiocarcinoma, hepatocellular carcinoma, adenoid cystic carcinoma, carcinoid tumor of appendix, prolactinoma, oncocytoma, hurthle cell adenoma, renal cell carcinoma, grawitz tumor, multiple endocrine adenomas, endometrioid adenoma, adnexal and skin appendage neoplasms, mucoepidermoid neoplasms, cystic, mucinous and serous neoplasms, cystadenoma, pseudomyxoma peritonei, ductal, lobular and medullary neoplasms, acinar cell neoplasms, complex epithelial neoplasms, warthin's tumor, thymoma, specialized gonadal neoplasms, sex cord stromal tumor, thecoma, granulosa cell tumor, arrhenoblastoma, sertoli leydig cell tumor, *glomus* tumors, paraganglioma, pheochromocytoma, *glomus* tumor, nevi and melanomas, melanocytic nevus, malignant melanoma, melanoma, nodular melanoma, dysplastic nevus, lentigo maligna melanoma, superficial spreading melanoma, and malignant acral lentiginous melanoma. Sarcoma includes without limitation Askin's tumor, botryodies, chondrosarcoma, Ewing's sarcoma, malignant hemangio endothelioma, malignant schwannoma, osteosarcoma, soft tissue sarcomas including: alveolar soft part sarcoma, angiosarcoma, cystosarcoma phyllodes, dermatofibrosarcoma, desmoid tumor, desmoplastic small round cell tumor, epithelioid sarcoma, extraskeletal chondrosarcoma, extraskeletal osteosarcoma, fibrosarcoma, hemangiopericytoma, hemangiosarcoma, kaposi's sarcoma, leiomyosarcoma, liposarcoma, lymphangiosarcoma, lymphosarcoma, malignant fibrous histiocytoma, neurofibrosarcoma, rhabdomyosarcoma, and synovialsarcoma. Lymphoma and leukemia include without limitation chronic lymphocytic leukemia/small lymphocytic lymphoma, B-cell prolymphocytic leukemia, lymphoplasmacytic lymphoma (such as waldenstrim macroglobulinemia), splenic marginal zone lymphoma, plasma cell myeloma, plasmacytoma, monoclonal immunoglobulin deposition diseases, heavy chain diseases, extranodal marginal zone B cell lymphoma, also called malt lymphoma, nodal marginal zone B cell lymphoma (nnzl), follicular lymphoma, mantle cell lymphoma, diffuse large B cell lymphoma, mediastinal (thymic) large B cell lymphoma, intravascular large B cell lymphoma, primary effusion lymphoma, burkitt lymphoma/leukemia, T cell prolymphocytic leukemia, T cell large granular lymphocytic leukemia, aggressive NK cell leukemia, adult T cell leukemia/lymphoma, extranodal NK/T cell lymphoma, nasal type, enteropathy-type T cell lymphoma, hepatosplenic T cell lymphoma, blastic NK cell lymphoma, mycosis fungoides/sezay syndrome, primary cutaneous CD30-positive T cell lymphoproliferative disorders, primary cutaneous anaplastic large cell lymphoma, lymphomatoid papulosis, angioimmunoblastic T cell lymphoma, peripheral T cell lymphoma, unspecified, anaplastic large cell lymphoma, classical hodgkin lymphomas (nodular sclerosis, mixed cellularity, lymphocyte-rich, lymphocyte depleted or not depleted), and nodular lymphocyte-predominant hodgkin lymphoma. Germ cell tumors include without limitation germinoma, dysgerminoma, seminoma, nongerminomatous germ cell tumor, embryonal carcinoma, endodermal sinus turmor, choriocarcinoma, teratoma, polyembryoma, and gonadoblastoma. Blastoma includes without limitation nephroblastoma, medulloblastoma, and retinoblastoma. Other cancers include without limitation labial carcinoma, larynx carcinoma, hypopharynx carcinoma, tongue carcinoma, salivary gland carcinoma, gastric carcinoma, adenocarcinoma, thyroid cancer (medullary and papillary thyroid carcinoma), renal carcinoma, kidney parenchyma carcinoma, cervix carcinoma, uterine corpus carcinoma, endometrium carcinoma, chorion carcinoma, testis carcinoma, urinary carcinoma, melanoma, brain tumors such as glioblastoma, astrocytoma, meningioma, medulloblastoma and peripheral neuroectodermal tumors, gall bladder carcinoma, bronchial carcinoma, multiple myeloma, basalioma, teratoma, retinoblastoma, choroidea melanoma, seminoma, rhabdomyosarcoma, craniopharyngeoma, osteosarcoma, chondrosarcoma, myosarcoma, liposarcoma, fibrosarcoma, Ewing sarcoma, and plasmocytoma.

In a further embodiment, the cancer under analysis may be a lung cancer including non-small cell lung cancer and small cell lung cancer (including small cell carcinoma (oat cell cancer), mixed small cell/large cell carcinoma, and combined small cell carcinoma), colon cancer, breast cancer, prostate cancer, liver cancer, pancreas cancer, brain cancer, kidney cancer, ovarian cancer, stomach cancer, skin cancer, bone cancer, gastric cancer, breast cancer, pancreatic cancer, glioma, glioblastoma, hepatocellular carcinoma, papillary renal carcinoma, head and neck squamous cell carcinoma, leukemia, lymphoma, myeloma, or a solid tumor.

In embodiments, the cancer comprises an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sézary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenstrim macroglobulinemia; or Wilm's tumor. The methods of the invention can be used to characterize these and other cancers. Thus, characterizing a phenotype can be providing a diagnosis, prognosis or theranosis of one of the cancers disclosed herein.

In some embodiments, the cancer comprises an acute myeloid leukemia (AML), breast carcinoma, cholangiocarcinoma, colorectal adenocarcinoma, extrahepatic bile duct adenocarcinoma, female genital tract malignancy, gastric adenocarcinoma, gastroesophageal adenocarcinoma, gastrointestinal stromal tumors (GIST), glioblastoma, head and neck squamous carcinoma, leukemia, liver hepatocellular carcinoma, low grade glioma, lung bronchioloalveolar carcinoma (BAC), lung non-small cell lung cancer (NSCLC), lung small cell cancer (SCLC), lymphoma, male genital tract malignancy, malignant solitary fibrous tumor of the pleura (MSFT), melanoma, multiple myeloma, neuroendocrine tumor, nodal diffuse large B-cell lymphoma, non epithelial ovarian cancer (non-EOC), ovarian surface epithelial carcinoma, pancreatic adenocarcinoma, pituitary carcinomas, oligodendroglioma, prostatic adenocarcinoma, retroperitoneal or peritoneal carcinoma, retroperitoneal or peritoneal sarcoma, small intestinal malignancy, soft tissue tumor, thymic carcinoma, thyroid carcinoma, or uveal melanoma. The methods of the invention can be used to characterize these and other cancers. Thus, characterizing a phenotype can be providing a diagnosis, prognosis or theranosis of one of the cancers disclosed herein.

The phenotype can also be an inflammatory disease, immune disease, or autoimmune disease. For example, the disease may be inflammatory bowel disease (IBD), Crohn's disease (CD), ulcerative colitis (UC), pelvic inflammation, vasculitis, psoriasis, diabetes, autoimmune hepatitis, Multiple Sclerosis, Myasthenia Gravis, Type I diabetes, Rheumatoid Arthritis, Psoriasis, Systemic Lupus Erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis.

The phenotype can also comprise a cardiovascular disease, such as atherosclerosis, congestive heart failure, vulnerable plaque, stroke, or ischemia. The cardiovascular disease or condition can be high blood pressure, stenosis, vessel occlusion or a thrombotic event.

The phenotype can also comprise a neurological disease, such as Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The phenotype may also be a condition such as fibromyalgia, chronic neuropathic pain, or peripheral neuropathic pain.

The phenotype may also comprise an infectious disease, such as a bacterial, viral or yeast infection. For example, the disease or condition may be Whipple's Disease, Prion Disease, cirrhosis, methicillin-resistant *staphylococcus aureus*, HIV, hepatitis, syphilis, meningitis, malaria, tuberculosis, or influenza. Viral proteins, such as HIV or HCV-like particles can be assessed in a vesicle, to characterize a viral condition.

The phenotype can also comprise a perinatal or pregnancy related condition (e.g. preeclampsia or preterm birth), metabolic disease or condition, such as a metabolic disease or condition associated with iron metabolism. For example, hepcidin can be assayed in a vesicle to characterize an iron deficiency. The metabolic disease or condition can also be diabetes, inflammation, or a perinatal condition.

The compositions and methods of the invention can be used to characterize these and other diseases and disorders that can be assessed via biomarkers. Thus, characterizing a phenotype can be providing a diagnosis, prognosis or theranosis of one of the diseases and disorders disclosed herein.

Subject

One or more phenotypes of a subject can be determined by analyzing one or more vesicles, such as vesicles, in a biological sample obtained from the subject. A subject or patient can include, but is not limited to, mammals such as bovine, avian, canine, equine, feline, ovine, porcine, or primate animals (including humans and non-human primates). A subject can also include a mammal of importance due to being endangered, such as a Siberian tiger; or economic importance, such as an animal raised on a farm for consumption by humans, or an animal of social importance to humans, such as an animal kept as a pet or in a zoo. Examples of such animals include, but are not limited to, carnivores such as cats and dogs; swine including pigs, hogs and wild boars; ruminants or ungulates such as cattle, oxen, sheep, giraffes, deer, goats, bison, camels or horses. Also included are birds that are endangered or kept in zoos, as well as fowl and more particularly domesticated fowl, i.e. poultry, such as turkeys and chickens, ducks, geese, guinea fowl. Also included are domesticated swine and horses (including race horses). In addition, any animal species connected to commercial activities are also included such as those animals connected to agriculture and aquaculture and other activities in which disease monitoring, diagnosis, and therapy selection are routine practice in husbandry for economic productivity and/or safety of the food chain.

The subject can have a pre-existing disease or condition, such as cancer. Alternatively, the subject may not have any known pre-existing condition. The subject may also be non-responsive to an existing or past treatment, such as a treatment for cancer.

Samples

A sample used and/or assessed via the compositions and methods of the invention includes any relevant biological sample that can be used for biomarker assessment, including without limitation sections of tissues such as biopsy or tissue removed during surgical or other procedures, bodily fluids, autopsy samples, frozen sections taken for histological purposes, and cell cultures. Such samples include blood and blood fractions or products (e.g., serum, buffy coat, plasma, platelets, red blood cells, and the like), sputum, malignant effusion, cheek cells tissue, cultured cells (e.g., primary cultures, explants, and transformed cells), stool, urine, other biological or bodily fluids (e.g., prostatic fluid, gastric fluid, intestinal fluid, renal fluid, lung fluid, cerebrospinal fluid, and the like), etc. The sample can comprise biological material that is a fresh frozen & formalin fixed paraffin embedded (FFPE) block, formalin-fixed paraffin embedded, or is within an RNA preservative+formalin fixative. More than one sample of more than one type can be used for each patient.

The sample used in the methods described herein can be a formalin fixed paraffin embedded (FFPE) sample. The FFPE sample can be one or more of fixed tissue, unstained slides, bone marrow core or clot, core needle biopsy, malignant fluids and fine needle aspirate (FNA). In an embodiment, the fixed tissue comprises a tumor containing formalin fixed paraffin embedded (FFPE) block from a surgery or biopsy. In another embodiment, the unstained slides comprise unstained, charged, unbaked slides from a paraffin block. In another embodiment, bone marrow core or clot comprises a decalcified core. A formalin fixed core and/or clot can be paraffin-embedded. In still another embodiment, the core needle biopsy comprises 1, 2, 3, 4, 5, 6, 7, 8, 9, 10 or more, e.g., 3-4, paraffin embedded biopsy samples. An 18 gauge needle biopsy can be used. The malignant fluid can comprise a sufficient volume of fresh pleural/ascitic fluid to produce a 5×5×2 mm cell pellet. The fluid can be formalin fixed in a paraffin block. In an embodiment, the core needle biopsy comprises 1, 2, 3, 4, 5, 6, 7, 8, 9, 10 or more, e.g., 4-6, paraffin embedded aspirates.

A sample may be processed according to techniques understood by those in the art. A sample can be without limitation fresh, frozen or fixed cells or tissue. In some embodiments, a sample comprises formalin-fixed paraffin-embedded (FFPE) tissue, fresh tissue or fresh frozen (FF) tissue. A sample can comprise cultured cells, including primary or immortalized cell lines derived from a subject sample. A sample can also refer to an extract from a sample from a subject. For example, a sample can comprise DNA, RNA or protein extracted from a tissue or a bodily fluid. Many techniques and commercial kits are available for such purposes. The fresh sample from the individual can be treated with an agent to preserve RNA prior to further processing, e.g., cell lysis and extraction. Samples can include frozen samples collected for other purposes. Samples can be associated with relevant information such as age, gender, and clinical symptoms present in the subject; source of the sample; and methods of collection and storage of the sample. A sample is typically obtained from a subject.

A biopsy comprises the process of removing a tissue sample for diagnostic or prognostic evaluation, and to the tissue specimen itself. Any biopsy technique known in the art can be applied to the molecular profiling methods of the present invention. The biopsy technique applied can depend on the tissue type to be evaluated (e.g., colon, prostate, kidney, bladder, lymph node, liver, bone marrow, blood cell, lung, breast, etc.), the size and type of the tumor (e.g., solid or suspended, blood or ascites), among other factors. Representative biopsy techniques include, but are not limited to, excisional biopsy, incisional biopsy, needle biopsy, surgical biopsy, and bone marrow biopsy. An "excisional biopsy" refers to the removal of an entire tumor mass with a small margin of normal tissue surrounding it. An "incisional biopsy" refers to the removal of a wedge of tissue that includes a cross-sectional diameter of the tumor. Molecular profiling can use a "core-needle biopsy" of the tumor mass, or a "fine-needle aspiration biopsy" which generally obtains a suspension of cells from within the tumor mass. Biopsy techniques are discussed, for example, in Harrison's Principles of Internal Medicine, Kasper, et al., eds., 16th ed., 2005, Chapter 70, and throughout Part V.

Standard molecular biology techniques known in the art and not specifically described are generally followed as in Sambrook et al., Molecular Cloning: A Laboratory Manual, Cold Spring Harbor Laboratory Press, New York (1989), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683,202; 4,801,531; 5,192,659 and 5,272,057 and incorporated herein by reference. Polymerase chain reaction (PCR) can be carried out generally as in PCR Protocols: A Guide to Methods and Applications, Academic Press, San Diego, Calif. (1990).

The biological sample assessed using the compositions and methods of the invention can be any useful bodily or biological fluid, including but not limited to peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen (including prostatic fluid), Cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, other lavage fluids, cells, cell culture, or a cell culture supernatant. A biological sample may also include the blastocyl cavity, umbilical cord blood, or maternal circulation which may be of fetal or maternal origin. The biological sample may also be a cell culture, tissue sample or biopsy from which vesicles and other circulating biomarkers may be obtained. For example, cells of interest can be cultured and vesicles isolated from the culture. In various embodiments, biomarkers or more particularly biosignatures disclosed herein can be assessed directly from such biological samples (e.g., identification of presence or levels of nucleic acid or polypeptide biomarkers or functional fragments thereof) using various methods, such as extraction of nucleic acid molecules from blood, plasma, serum or any of the foregoing biological samples, use of protein or antibody arrays to identify polypeptide (or functional fragment) biomarker(s), as well as other array, sequencing, PCR and proteomic techniques known in the art for identification and assessment of nucleic acid and polypeptide molecules. In addition, one or more components present in such samples can be first isolated or enriched and further processed to assess the presence or levels of selected biomarkers, to assess a given biosignature (e.g., isolated microvesicles prior to profiling for protein and/or nucleic acid biomarkers).

Table 1 presents a non-limiting listing of diseases, conditions, or biological states and corresponding biological samples that may be used for analysis according to the methods of the invention.

TABLE 1

Examples of Biological Samples for Various Diseases, Conditions, or Biological States

| Illustrative Disease, Condition or Biological State | Illustrative Biological Samples |
|---|---|
| Cancers/neoplasms affecting the following tissue types/bodily systems: breast, lung, ovarian, colon, rectal, prostate, pancreatic, brain, bone, connective tissue, glands, skin, lymph, nervous system, endocrine, germ cell, genitourinary, hematologic/blood, bone marrow, muscle, eye, esophageal, fat tissue, thyroid, pituitary, spinal cord, bile duct, heart, gall bladder, bladder, testes, cervical, endometrial, renal, ovarian, digestive/gastrointestinal, stomach, head and neck, liver, leukemia, respiratory/thoracic, cancers of unknown primary (CUP) | Tumor, blood, serum, plasma, cerebrospinal fluid (CSF), urine, sputum, ascites, synovial fluid, semen, nipple aspirates, saliva, bronchoalveolar lavage fluid, tears, oropharyngeal washes, feces, peritoneal fluids, pleural effusion, sweat, tears, aqueous humor, pericardial fluid, lymph, chyme, chyle, bile, stool water, amniotic fluid, breast milk, pancreatic juice, cerumen, Cowper's fluid or pre-ejaculatory fluid, female ejaculate, interstitial fluid, menses, mucus, pus, sebum, vaginal lubrication, vomit |
| Neurodegenerative/neurological disorders: Parkinson's disease, Alzheimer's Disease and multiple sclerosis, Schizophrenia, and bipolar disorder, spasticity disorders, epilepsy | Blood, serum, plasma, CSF, urine |
| Cardiovascular Disease: atherosclerosis, cardiomyopathy, endocarditis, vunerable plaques, infection | Blood, serum, plasma, CSF, urine |
| Stroke: ischemic, intracerebral hemorrhage, subarachnoid hemorrhage, transient ischemic attacks (TIA) | Blood, serum, plasma, CSF, urine |
| Pain disorders: peripheral neuropathic pain and chronic neuropathic pain, and fibromyalgia, | Blood, serum, plasma, CSF, urine |
| Autoimmune disease: systemic and localized diseases, rheumatic disease, Lupus, Sjogren's syndrome | Blood, serum, plasma, CSF, urine, synovial fluid |
| Digestive system abnormalities: Barrett's esophagus, irritable bowel syndrome, ulcerative colitis, Crohn's disease, Diverticulosis and Diverticulitis, Celiac Disease | Blood, serum, plasma, CSF, urine |
| Endocrine disorders: diabetes mellitus, various forms of Thyroiditis, adrenal disorders, pituitary disorders | Blood, serum, plasma, CSF, urine |
| Diseases and disorders of the skin: psoriasis | Blood, serum, plasma, CSF, urine, synovial fluid, tears |
| Urological disorders: benign prostatic hypertrophy (BPH), polycystic kidney disease, interstitial cystitis | Blood, serum, plasma, urine |
| Hepatic disease/injury: Cirrhosis, induced hepatotoxicity (due to exposure to natural or synthetic chemical sources) | Blood, serum, plasma, urine |
| Kidney disease/injury: acute, sub-acute, chronic conditions, Podocyte injury, focal segmental glomerulosclerosis | Blood, serum, plasma, urine |
| Endometriosis | Blood, serum, plasma, urine, vaginal fluids |
| Osteoporosis | Blood, serum, plasma, urine, synovial fluid |
| Pancreatitis | Blood, serum, plasma, urine, pancreatic juice |
| Asthma | Blood, serum, plasma, urine, sputum, bronchiolar lavage fluid |
| Allergies | Blood, serum, plasma, urine, sputum, bronchiolar lavage fluid |
| Prion-related diseases | Blood, serum, plasma, CSF, urine |
| Viral Infections: HIV/AIDS | Blood, serum, plasma, urine |
| Sepsis | Blood, serum, plasma, urine, tears, nasal lavage |

TABLE 1-continued

Examples of Biological Samples for Various Diseases, Conditions, or Biological States

| Illustrative Disease, Condition or Biological State | Illustrative Biological Samples |
|---|---|
| Organ rejection/transplantation | Blood, serum, plasma, urine, various lavage fluids |
| Werentiating conditions: adenoma versus hyperplastic polyp, irritable bowel syndrome (IBS) versus normal, classifying Dukes stages A, B, C, and/or D of colon cancer, adenoma with low-grade hyperplasia versus high-grade hyperplasia, adenoma versus normal, colorectal cancer versus normal, IBS versus. ulcerative colitis (UC) versus Crohn's disease (CD), | Blood, serum, plasma, urine, sputum, feces, colonic lavage fluid |
| Pregnancy related physiological states, conditions, or affiliated diseases: genetic risk, adverse pregnancy outcomes | Maternal serum, plasma, amniotic fluid, cord blood |

The methods of the invention can be used to characterize a phenotype using a blood sample or blood derivative. Blood derivatives include plasma and serum. Blood plasma is the liquid component of whole blood, and makes up approximately 55% of the total blood volume. It is composed primarily of water with small amounts of minerals, salts, ions, nutrients, and proteins in solution. In whole blood, red blood cells, leukocytes, and platelets are suspended within the plasma. Blood serum refers to blood plasma without fibrinogen or other clotting factors (i.e., whole blood minus both the cells and the clotting factors).

The biological sample may be obtained through a third party, such as a party not performing the analysis of the biomarkers, whether direct assessment of a biological sample or by profiling one or more vesicles obtained from the biological sample. For example, the sample may be obtained through a clinician, physician, or other health care manager of a subject from which the sample is derived. Alternatively, the biological sample may obtained by the same party analyzing the vesicle. In addition, biological samples be assayed, are archived (e.g., frozen) or ortherwise stored in under preservative conditions.

Furthermore, a biological sample can comprise a vesicle or cell membrane fragment that is derived from a cell of origin and available extracellularly in a subject's biological fluid or extracellular milieu.

Methods of the invention can include assessing one or more vesicles, including assessing vesicle populations. A vesicle, as used herein, is a membrane vesicle that is shed from cells. Vesicles or membrane vesicles include without limitation: circulating microvesicles (cMVs), microvesicle, exosome, nanovesicle, dexosome, bleb, blebby, prostasome, microparticle, intralumenal vesicle, membrane fragment, intralumenal endosomal vesicle, endosomal-like vesicle, exocytosis vehicle, endosome vesicle, endosomal vesicle, apoptotic body, multivesicular body, secretory vesicle, phospholipid vesicle, liposomal vesicle, argosome, texasome, secresome, tolerosome, melanosome, oncosome, or exocytosed vehicle. Furthermore, although vesicles may be produced by different cellular processes, the methods of the invention are not limited to or reliant on any one mechanism, insofar as such vesicles are present in a biological sample and are capable of being characterized by the methods disclosed herein. Unless otherwise specified, methods that make use of a species of vesicle can be applied to other types of vesicles. Vesicles comprise spherical structures with a lipid bilayer similar to cell membranes which surrounds an inner compartment which can contain soluble components, sometimes referred to as the payload. In some embodiments, the methods of the invention make use of exosomes, which are small secreted vesicles of about 40-100 nm in diameter. For a review of membrane vesicles, including types and characterizations, see Thery et al., Nat Rev Immunol. 2009 August; 9(8):581-93. Some properties of different types of vesicles include those in Table 2:

TABLE 2

Vesicle Properties

| Feature | Exosomes | Microvesicles | Ectosomes | Membrane particles | Exosome-like vesicles | Apoptotic vesicles |
|---|---|---|---|---|---|---|
| Size | 50-100 nm | 100-1,000 nm | 50-200 nm | 50-80 nm | 20-50 nm | 50-500 nm |
| Density in sucrose | 1.13-1.19 g/ml | | | 1.04-1.07 g/ml | 1.1 g/ml | 1.16-1.28 g/ml |
| EM appearance | Cup shape | Irregular shape, electron dense | Bilamellar round structures | Round | Irregular shape | Heterogeneous |
| Sedimentation | 100,000 g | 10,000 g | 160,000-200,000 g | 100,000-200,000 g | 175,000 g | 1,200 g, 10,000 g, 100,000 g |
| Lipid composition | Enriched in cholesterol, sphingomyelin and ceramide; contains lipid rafts; expose PPS | Expose PPS | Enriched in cholesterol and diacylglycerol; expose PPS | | No lipid rafts | |

TABLE 2-continued

Vesicle Properties

| Feature | Exosomes | Microvesicles | Ectosomes | Membrane particles | Exosome-like vesicles | Apoptotic vesicles |
|---|---|---|---|---|---|---|
| Major protein markers | Tetraspanins (e.g., CD63, CD9), Alix, TSG101 | Integrins, selectins and CD40 ligand | CR1 and proteolytic enzymes; no CD63 | CD133; no CD63 | TNFRI | Histones |
| Intracellular origin | Internal compartments (endosomes) | Plasma membrane | Plasma membrane | Plasma membrane | | |

Abbreviations:
phosphatidylserine (PPS);
electron microscopy (EM)

Vesicles include shed membrane bound particles, or "microparticles," that are derived from either the plasma membrane or an internal membrane. Vesicles can be released into the extracellular environment from cells. Cells releasing vesicles include without limitation cells that originate from, or are derived from, the ectoderm, endoderm, or mesoderm. The cells may have undergone genetic, environmental, and/or any other variations or alterations. For example, the cell can be tumor cells. A vesicle can reflect any changes in the source cell, and thereby reflect changes in the originating cells, e.g., cells having various genetic mutations. In one mechanism, a vesicle is generated intracellularly when a segment of the cell membrane spontaneously invaginates and is ultimately exocytosed (see for example, Keller et al., Immunol. Lett. 107 (2): 102-8 (2006)). Vesicles also include cell-derived structures bounded by a lipid bilayer membrane arising from both herniated evagination (blebbing) separation and sealing of portions of the plasma membrane or from the export of any intracellular membrane-bounded vesicular structure containing various membrane-associated proteins of tumor origin, including surface-bound molecules derived from the host circulation that bind selectively to the tumor-derived proteins together with molecules contained in the vesicle lumen, including but not limited to tumor-derived microRNAs or intracellular proteins. Blebs and blebbing are further described in Charras et al., Nature Reviews Molecular and Cell Biology, Vol. 9, No. 11, p. 730-736 (2008). A vesicle shed into circulation or bodily fluids from tumor cells may be referred to as a "circulating tumor-derived vesicle." When such vesicle is an exosome, it may be referred to as a circulating-tumor derived exosome (CTE). In some instances, a vesicle can be derived from a specific cell of origin. CTE, as with a cell-of-origin specific vesicle, typically have one or more unique biomarkers that permit isolation of the CTE or cell-of-origin specific vesicle, e.g., from a bodily fluid and sometimes in a specific manner. For example, a cell or tissue specific markers are used to identify the cell of origin. Examples of such cell or tissue specific markers are disclosed herein and can further be accessed in the Tissue-specific Gene Expression and Regulation (TiGER) Database, available at bioinfo.wilmer.jhu.edu/tiger/; Liu et al. (2008) TiGER: a database for tissue-specific gene expression and regulation. BMC Bioinformatics. 9:271; TissueDistributionDBs, available at genome.dkfz-heidelberg.de/menu/tissue_db/index.html.

A vesicle can have a diameter of greater than about 10 nm, 20 nm, or 30 nm. A vesicle can have a diameter of greater than 40 nm, 50 nm, 100 nm, 200 nm, 500 nm, 1000 nm, 1500 nm, 2000 nm or greater than 10,000 nm. A vesicle can have a diameter of about 20-2000 nm, about 20-1500 nm, about 30-1000 nm, about 30-800 nm, about 30-200 nm, or about 30-100 nm. In some embodiments, the vesicle has a diameter of less than 10,000 nm, 2000 nm, 1500 nm, 1000 nm, 800 nm, 500 nm, 200 nm, 100 nm, 50 nm, 40 nm, 30 nm, 20 nm or less than 10 nm. As used herein the term "about" in reference to a numerical value means that variations of 10% above or below the numerical value are within the range ascribed to the specified value. Typical sizes for various types of vesicles are shown in Table 2. Vesicles can be assessed to measure the diameter of a single vesicle or any number of vesicles. For example, the range of diameters of a vesicle population or an average diameter of a vesicle population can be determined. Vesicle diameter can be assessed using methods known in the art, e.g., imaging technologies such as electron microscopy. In an embodiment, a diameter of one or more vesicles is determined using optical particle detection. See, e.g., U.S. Pat. No. 7,751,053, entitled "Optical Detection and Analysis of Particles" and issued Jul. 6, 2010; and U.S. Pat. No. 7,399,600, entitled "Optical Detection and Analysis of Particles" and issued Jul. 15, 2010.

Figure 15A:
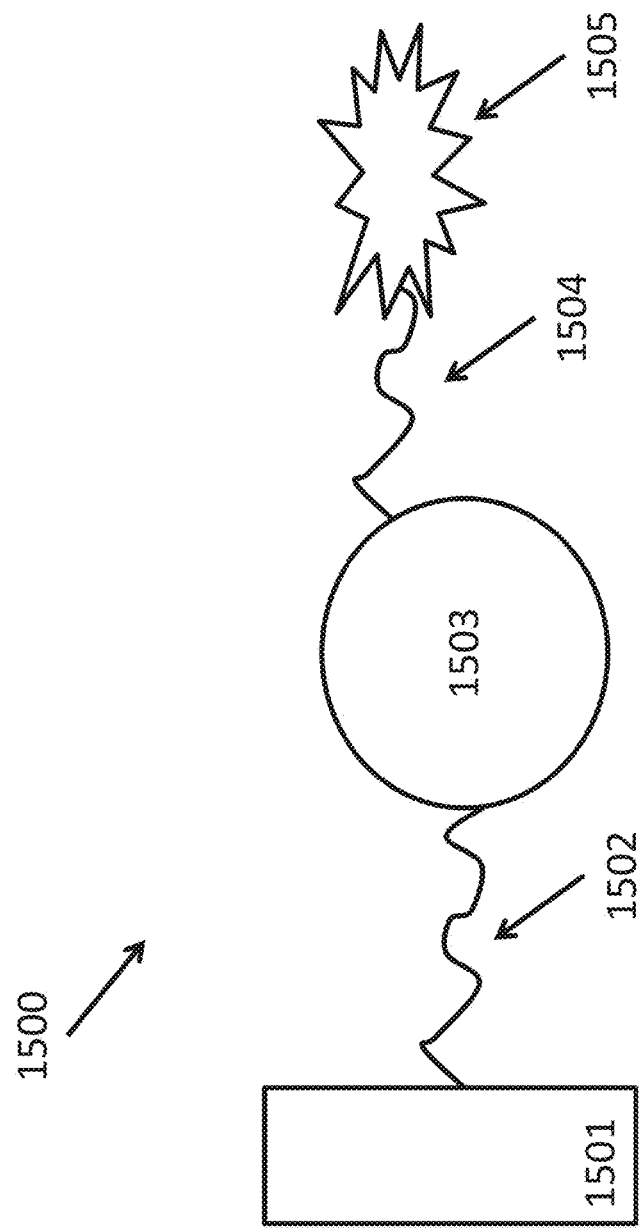
FIGS. 15A-B illustrate use of aptamers in methods of characterizing a phenotype.
Figure 15B:
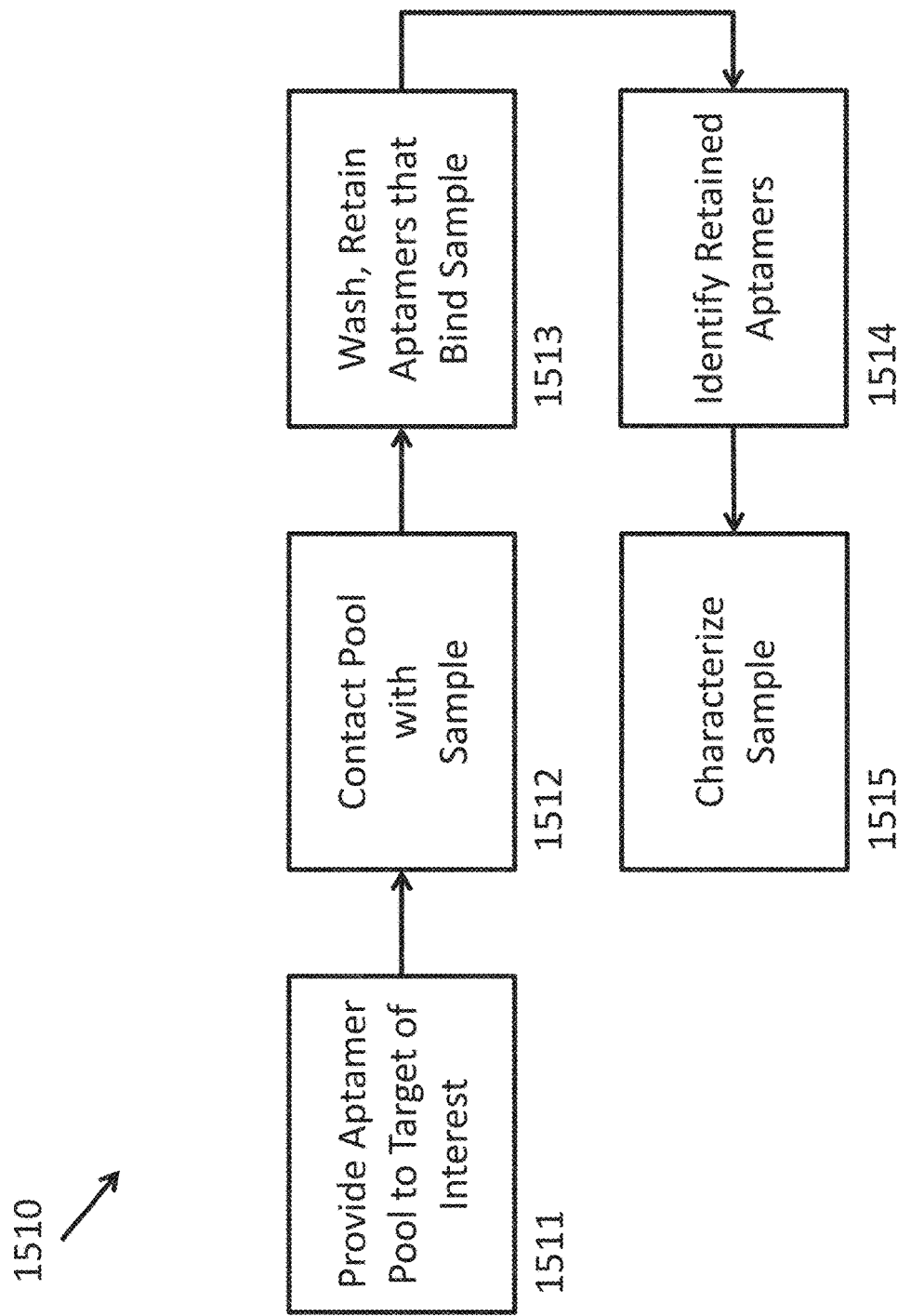
Figure 15C:
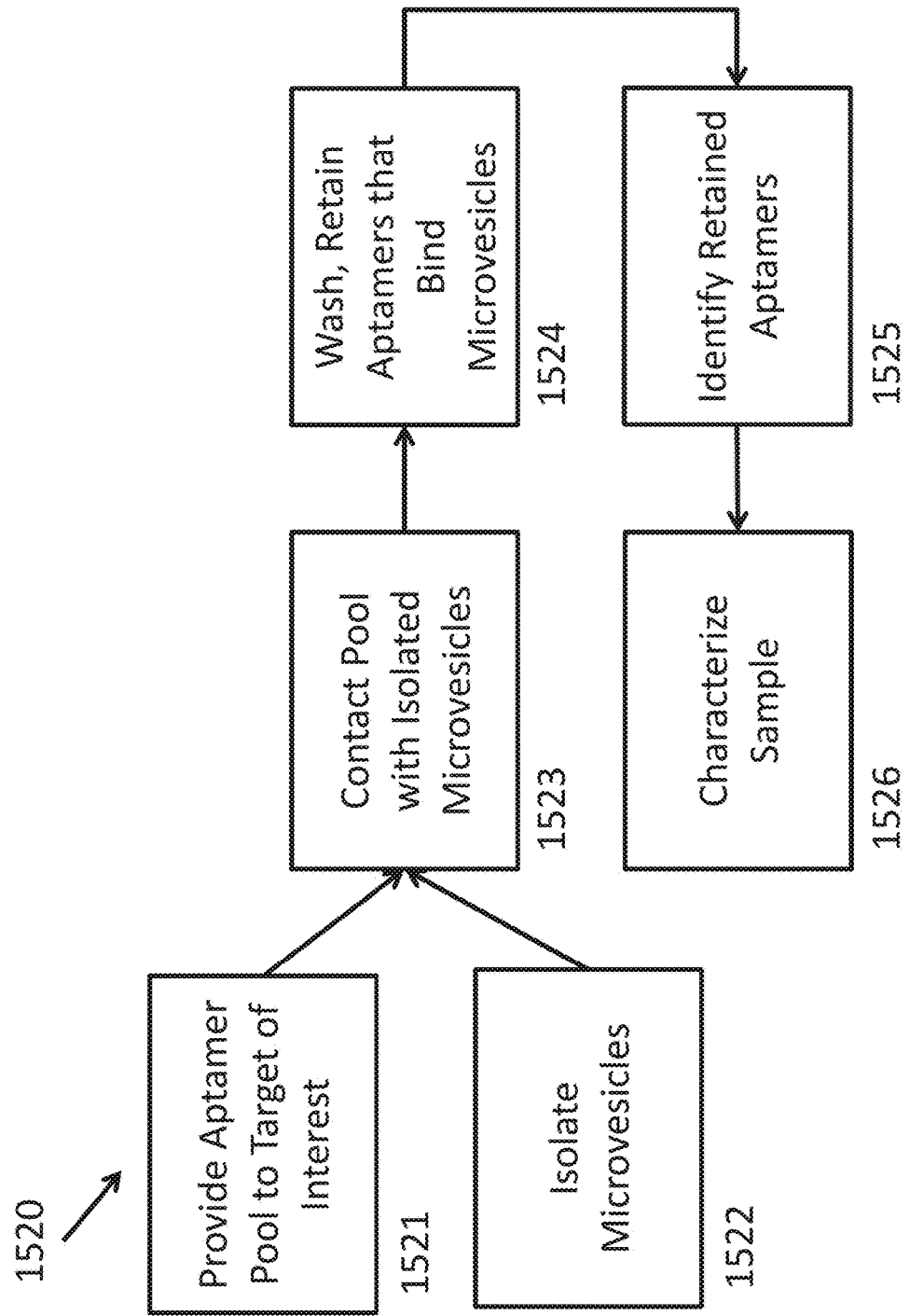
FIG. 15C is a schematic 1520 showing an implementation of the method in FIG. 15B. A pool of aptamers identified as binding a microvesicle population is provided 1521. The input sample comprises microvesicles that are isolated from a test sample 1522. The pool is contacted with the isolated microvesicles to be characterized 1523. The mixture is washed to remove unbound aptamers and the remaining aptamers are disassociated and collected 1525. The collected aptamers are identified and the identity of the retained aptamers is used to characterize the phenotype 1526.

In some embodiments, the methods of the invention comprise assessing vesicles directly such as in a biological sample without prior isolation, purification, or concentration from the biological sample. For example, the amount of vesicles in the sample can by itself provide a biosignature that provides a diagnostic, prognostic or theranostic determination. Alternatively, the vesicle in the sample may be isolated, captured, purified, or concentrated from a sample prior to analysis. As noted, isolation, capture or purification as used herein comprises partial isolation, partial capture or partial purification apart from other components in the sample. Vesicle isolation can be performed using various techniques as described herein, e.g., chromatography, filtration, centrifugation, flow cytometry, affinity capture (e.g., to a planar surface or bead), and/or using microfluidics. FIGS. 15B-15C present an overview of a method of the invention for assessing microvesicles using an aptamer pool.

Vesicles such as exosomes can be assessed to provide a phenotypic characterization by comparing vesicle characteristics to a reference. In some embodiments, surface antigens on a vesicle are assessed. The surface antigens can provide an indication of the anatomical origin and/or cellular of the vesicles and other phenotypic information, e.g., tumor status. For example, wherein vesicles found in a patient sample, e.g., a bodily fluid such as blood, serum or plasma, are assessed for surface antigens indicative of colorectal origin and the presence of cancer. The surface antigens may comprise any informative biological entity that can be detected on the vesicle membrane surface, including without limitation surface proteins, lipids, carbohydrates, and other membrane components. For example, positive detection of colon derived vesicles expressing tumor antigens can indicate that the patient has colorectal cancer. As such, methods of the invention can be used to characterize any disease or condition associated with an anatomical or cellular origin, by assessing, for example, disease-specific and cell-specific biomarkers of one or more vesicles obtained from a subject.

In another embodiment, the methods of the invention comprise assessing one or more vesicle payload to provide a phenotypic characterization. The payload with a vesicle comprises any informative biological entity that can be detected as encapsulated within the vesicle, including without limitation proteins and nucleic acids, e.g., genomic or cDNA, mRNA, or functional fragments thereof, as well as microRNAs (miRs). In addition, methods of the invention are directed to detecting vesicle surface antigens (in addition or exclusive to vesicle payload) to provide a phenotypic characterization. For example, vesicles can be characterized by using binding agents (e.g., antibodies or aptamers) that are specific to vesicle surface antigens, and the bound vesicles can be further assessed to identify one or more payload components disclosed therein. As described herein, the levels of vesicles with surface antigens of interest or with payload of interest can be compared to a reference to characterize a phenotype. For example, overexpression in a sample of cancer-related surface antigens or vesicle payload, e.g., a tumor associated mRNA or microRNA, as compared to a reference, can indicate the presence of cancer in the sample. The biomarkers assessed can be present or absent, increased or reduced based on the selection of the desired target sample and comparison of the target sample to the desired reference sample. Non-limiting examples of target samples include: disease; treated/not-treated; different time points, such as a in a longitudinal study; and non-limiting examples of reference sample: non-disease; normal; different time points; and sensitive or resistant to candidate treatment(s).

Biomarkers

As described herein, the methods and compositions of the invention can be used in assays to detect the presence or level of one or more biomarker of interest. The biomarker can be any useful biomarker disclosed herein or known to those of skill in the art. In an embodiment, the biomarker comprises a protein or polypeptide. As used herein, "protein," "polypeptide" and "peptide" are used interchangeably unless stated otherwise. The biomarker can be a nucleic acid, including DNA, RNA, and various subspecies of any thereof as disclosed herein or known in the art. The biomarker can comprise a lipid. The biomarker can comprise a carbohydrate. The biomarker can also be a complex, e.g., a complex comprising protein, nucleic acids, lipids and/or carbohydrates. In some embodiments, the biomarker comprises a microvesicle. In an embodiment, the invention provides a method wherein a pool of aptamers is used to assess the presence and/or level of a population of microvesicles of interest without knowing the precise microvesicle antigen targeted by each member of the pool. See, e.g., FIGS. 15B-C. In other cases, biomarkers associated with microvesicles are assessed according to the methods of the invention. See, e.g., FIGS. 1A-1F; FIG. 15A.

A biosignature comprising more than one biomarker can comprise one type of biomarker or multiple types of biomarkers. As a non-limiting example, a biosignature can comprise multiple proteins, multiple nucleic acids, multiple lipids, multiple carbohydrates, multiple biomarker complexes, multiple microvesicles, or a combination of any thereof. For example, the biosignature may comprise one or more microvesicle, one or more protein, and one or more microRNA, wherein the one or more protein and/or one or more microRNA is optionally in association with the microvesicle as a surface antigen and/or payload, as appropriate.

In some embodiments, vesicles are detected using vesicle surface antigens. A commonly expressed vesicle surface antigen can be referred to as a "housekeeping protein," or general vesicle biomarker. The biomarker can be CD63, CD9, CD81, CD82, CD37, CD53, Rab-5b, Annexin V or MFG-E8. Tetraspanins, a family of membrane proteins with four transmembrane domains, can be used as general vesicle biomarkers. The tetraspanins include CD151, CD53, CD37, CD82, CD81, CD9 and CD63. There have been over 30 tetraspanins identified in mammals, including the TSPAN1 (TSP-1), TSPAN2 (TSP-2), TSPAN3 (TSP-3), TSPAN4 (TSP-4, NAG-2), TSPAN5 (TSP-5), TSPAN6 (TSP-6), TSPAN7 (CD231, TALLA-1, A15), TSPAN8 (CO-029), TSPAN9 (NET-5), TSPAN10 (Oculospanin), TSPAN11 (CD151-like), TSPAN12 (NET-2), TSPAN13 (NET-6), TSPAN14, TSPAN15 (NET-7), TSPAN16 (TM4-B), TSPAN17, TSPAN18, TSPAN19, TSPAN20 (UP1b, UPK1B), TSPAN21 (UP1a, UPK1A), TSPAN22 (RDS, PRPH2), TSPAN23 (ROM1), TSPAN24 (CD151), TSPAN25 (CD53), TSPAN26 (CD37), TSPAN27 (CD82), TSPAN28 (CD81), TSPAN29 (CD9), TSPAN30 (CD63), TSPAN31 (SAS), TSPAN32 (TSSC6), TSPAN33, and TSPAN34. Other commonly observed vesicle markers include those listed in Table 3. One or more of these proteins can be useful biomarkers for the characterizing a phenotype using the subject methods and compositions.

TABLE 3

Proteins Observed in Vesicles from Multiple Cell Types

| Class | Protein |
| --- | --- |
| Antigen Presentation | MHC class I, MHC class II, Integrins, Alpha 4 beta 1, Alpha M beta 2, Beta 2 |
| Immunoglobulin family | ICAM1/CD54, P-selection |
| Cell-surface peptidases | Dipeptidylpeptidase IV/CD26, Aminopeptidase n/CD13 |
| Tetraspanins | CD151, CD53, CD37, CD82, CD81, CD9 and CD63 |
| Heat-shock proteins | Hsp70, Hsp84/90 |
| Cytoskeletal proteins | Actin, Actin-binding proteins, Tubulin |
| Membrane transport and fusion | Annexin I, Annexin II, Annexin IV, Annexin V, Annexin VI, RAB7/RAP1B/RADGDI |

TABLE 3-continued

Proteins Observed in Vesicles from Multiple Cell Types

| Class | Protein |
|---|---|
| Signal transduction | Gi2alpha/14-3-3, CBL/LCK |
| Abundant membrane proteins | CD63, GAPDH, CD9, CD81, ANXA2, ENO1, SDCBP, MSN, MFGE8, EZR, GK, ANXA1, LAMP2, DPP4, TSG101, HSPA1A, GDI2, CLTC, LAMP1, Cd86, ANPEP, TFRC, SLC3A2, RDX, RAP1B, RAB5C, RAB5B, MYH9, ICAM1, FN1, RAB11B, PIGR, LGALS3, ITGB1, EHD1, CLIC1, ATP1A1, ARF1, RAP1A, P4HB, MUC1, KRT10, HLA-A, FLOT1, CD59, C1orf58, BASP1, TACSTD1, STOM |
| Other Transmembrane Proteins | Cadherins: CDH1, CDH2, CDH12, CDH3, Deomoglein, DSG1, DSG2, DSG3, DSG4, Desmocollin, DSC1, DSG2, DSG3, Protocadherins, PCDH1, PCDH10, PCDH11x, PCDH11y, PCDH12, FAT, FAT2, FAT4, PCDH15, PCDH17, PCDH18, PCDH19; PCDH20; PCDH7, PCDH8, PCDH9, PCDHA1, PCDHA10, PCDHA11, PCDHA12, PCDHA13, PCDHA2, PCDHA3, PCDHA4, PCDHA5, PCDHA6, PCDHA7, PCDHA8, PCDHA9, PCDHAC1, PCDHAC2, PCDHB1, PCDHB10, PCDHB11, PCDHB12, PCDHB13, PCDHB14, PCDHB15, PCDHB16, PCDHB17, PCDHB18, PCDHB2, PCDHB3, PCDHB4, PCDHB5, PCDHB6, PCDHB7, PCDHB8, PCDHB9, PCDHGA1, PCDHGA10, PCDHGA11, PCDHGA12, PCDHGA2, PCDHGA3, PCDHGA4, PCDHGA5, PCDHGA6, PCDHGA7, PCDHGA8, PCDHGA9, PCDHGB1, PCDHGB2, PCDHGB3, PCDHGB4, PCDHGB5, PCDHGB6, PCDHGB7, PCDHGC3, PCDHGC4, PCDHGC5, CDH9 (cadherin 9, type 2 (T1-cadherin)), CDH10 (cadherin 10, type 2 (T2-cadherin)), CDH5 (VE-cadherin (vascular endothelial)), CDH6 (K-cadherin (kidney)), CDH7 (cadherin 7, type 2), CDH8 (cadherin 8, type 2), CDH11 (OB-cadherin (osteoblast)), CDH13 (T-cadherin-H-cadherin (heart)), CDH15 (M-cadherin (myotubule)), CDH16 (KSP-cadherin), CDH17 (LI cadherin (liver-intestine)), CDH18 (cadherin 18, type 2), CDH19 (cadherin 19, type 2), CDH20 (cadherin 20, type 2), CDH23 (cadherin 23, (neurosensory epithelium)), CDH10, CDH11, CDH13, CDH15, CDH16, CDH17, CDH18, CDH19, CDH20, CDH22, CDH23, CDH24, CDH26, CDH28, CDH4, CDH5, CDH6, CDH7, CDH8, CDH9, CELSR1, CELSR2, CELSR3, CLSTN1, CLSTN2, CLSTN3, DCHS1, DCHS2, LOC389118, PCLKC, RESDA1, RET |

Any of the types of biomarkers described herein can be used and/or assessed via the subject methods and compositions. Exemplary biomarkers include without limitation those in Table 4. The markers can be detected as protein or as mRNA, which can be circulating freely or in a complex with other biological molecules. As appropriate, the markers in Table 4 can also be used for capture and/or detection of vesicles for characterizing phenotypes as disclosed herein. In some cases, multiple capture and/or detectors are used to enhance the characterization. See, e.g., FIGS. 1C-1E. The markers can be detected as vesicle surface antigens and/or vesicle payload. The "Illustrative Class" indicates indications for which the markers are known markers. Those of skill will appreciate that the markers can also be used in alternate settings in certain instances. For example, a marker which can be used to characterize one type disease may also be used to characterize another disease as appropriate. Consider a non-limiting example of a tumor marker which can be used as a biomarker for tumors from various lineages. The biomarker references in Table 4 are those commonly used in the art. Gene aliases and descriptions can be found using a variety of online databases, including GeneCards® (www.genecards.org), HUGO Gene Nomenclature (www.genenames.org), Entrez Gene (www.ncbi.nlm.nih.gov/entrez/query.fcgi?db=gene), UniProtKB/Swiss-Prot (www.uniprot.org), UniProtKB/TrEMBL (www.uniprot.org), OMIM (www.ncbi.nlm.nih.gov/entrez/query.fcgi?db=OMIM), GeneLoc (genecards.weizmann.ac.il/geneloc/), and Ensembl (www.ensembl.org). Generally, gene symbols and names below correspond to those approved by HUGO, and protein names are those recommended by UniProtKB/Swiss-Prot. Common alternatives are provided as well. In some cases, biomarkers are referred to by Ensembl reference numbers, which are of the form "ENSG" followed by a number, e.g., ENSG00000005893 which corresponds to LAMP2. In Table 4, solely for sake of brevity, "E." is sometimes used to represent "ENSG00000". For example, "E.005893 represents "ENSG00000005893." Where a protein name indicates a precursor, the mature protein is also implied. Throughout the application, gene and protein symbols may be used interchangeably and the meaning can be derived from context as necessary.

TABLE 4

Illustrative Biomarkers

| Illustrative Class | Biomarkers |
|---|---|
| Drug associated targets and prognostic markers | ABCC1, ABCG2, ACE2, ADA, ADH1C, ADH4, AGT, AR, AREG, ASNS, BCL2, BCRP, BDCA1, beta III tubulin, BIRC5, B-RAF, BRCA1, BRCA2, CA2, caveolin, CD20, CD25, CD33, CD52, CDA, CDKN2A, CDKN1A, CDKN1B, CDK2, CDW52, CES2, CK 14, CK 17, CK 5/6, c-KIT, c-Met, c-Myc, COX-2, Cyclin D1, DCK, DHFR, DNMT1, DNMT3A, DNMT3B, E-Cadherin, ECGF1, EGFR, EML4-ALK fusion, EPHA2, Epiregulin, ER, ERBR2, ERCC1, ERCC3, EREG, ESR1, FLT1, folate receptor, FOLR1, FOLR2, FSHB, FSHPRHL FSHR, FYN, GART, GNA11, GNAQ, GNRH1, GNRHR1, GSTP1, HCK, HDAC1, hENT-1, Her2/Neu, HGF, HIF1A, HIG1, HSP90, HSP90AA1, HSPCA, IGF-1R, IGFRBP, IGFRBP3, IGFRBP4, IGFRBP5, IL13RA1, IL2RA, KDR, Ki67, KIT, K-RAS, |

TABLE 4-continued

Illustrative Biomarkers

| Illustrative Class | Biomarkers |
|---|---|
| | LCK, LTB, Lymphotoxin Beta Receptor, LYN, MET, MGMT, MLH1, MMR, MRP1, MS4A1, MSH2, MSH5, Myc, NFKB1, NFKB2, NFKBIA, NRAS, ODC1, OGFR, p16, p21, p27, p53, p95, PARP-1, PDGFC, PDGFR, PDGFRA, PDGFRB, PGP, PGR, PI3K, POLA, POLA1, PPARG, PPARGC1, PR, PTEN, PTGS2, PTPN12, RAF1, RARA, ROS1, RRM1, RRM2, RRM2B, RXRB, RXRG, SIK2, SPARC, SRC, SSTR1, SSTR2, SSTR3, SSTR4, SSTR5, Survivin, TK1, TLE3, TNF, TOP1, TOP2A, TOP2B, TS, TUBB3, TXN, TXNRDL TYMS, VDR, VEGF, VEGFA, VEGFC, VHL, YES1, ZAP70 |
| Drug associated targets and prognostic markers | ABL1, STK11, FGFR2, ERBB4, SMARCB1, CDKN2A, CTNNB1, FGFR1, FLT3, NOTCH1, NPM1, SRC, SMAD4, FBXW7, PTEN, TP53, AKT1, ALK, APC, CDH1, C-Met, HRAS, IDH1, JAK2, MPL, PDGFRA, SMO, VHL, ATM, CSF1R, FGFR3, GNAS, ERBB2, HNF1A, JAK3, KDR, MLH1, PTPN11, RB1, RET, c-Kit, EGFR, PIK3CA, NRAS, GNA11, GNAQ, KRAS, BRAF |
| Drug associated targets and prognostic markers | ALK, AR, BRAF, cKIT, cMET, EGFR, ER, ERCC1, GNA11, HER2, IDH1, KRAS, MGMT, MGMT promoter methylation, NRAS, PDGFRA, Pgp, PIK3CA, PR, PTEN, ROS1, RRM1, SPARC, TLE3, TOP2A, TOPO1, TS, TUBB3, VHL |
| Drug associated targets and prognostic markers | AR, cMET, EGFR, ER, HER2, MGMT, Pgp, PR, PTEN, RRM1, SPARC, TLE3, TOPO1, TOP2A, TS, TUBB3, ALK, cMET, HER2, ROS1, TOP2A, BRAF, IDH2, MGMT Methylation, ABL1, AKT1, ALK, APC, ATM, BRAF, CDH1, CSF1R, CTNNB1, EGFR, ERBB2 (HER2), ERBB4, FBXW7, FGFR1, FGFR2, FLT3, GNA11, GNAQ, GNAS, HNF1A, HRAS, IDH1, JAK2, JAK3, KDR (VEGFR2), KIT, KRAS, MET, MLH1, MPL, NOTCH1, NPM1, NRAS, PDGFRA, PIK3CA, PTEN, PTPN11, RB1, RET, SMAD4, SMARCB1, SMO, STK11, TP53, VHL |
| 5-aminosalicyclic acid (5-ASA) efficacy | μ-protocadherin, KLF4, CEBPα |
| Cancer treatment associated markers | AR, AREG (Amphiregulin), BRAF, BRCA1, cKIT, cMET, EGFR, EGFR w/T790M, EML4-ALK, ER, ERBB3, ERBB4, ERCC1, EREG, GNA11, GNAQ, hENT-1, Her2, Her2 Exon 20 insert, IGF1R, Ki67, KRAS, MGMT, MGMT methylation, MSH2, MSI, NRAS, PGP (MDR1), PIK3CA, PR, PTEN, ROS1, ROS1 translocation, RRM1, SPARC, TLE3, TOPO1, TOPO2A, TS, TUBB3, VEGFR2 |
| Cancer treatment associated markers | AR, AREG, BRAF, BRCA1, cKIT, cMET, EGFR, EGFR w/T790M, EML4-ALK, ER, ERBB3, ERBB4, ERCC1, EREG, GNA11, GNAQ, Her2, Her2 Exon 20 insert, IGFR1, Ki67, KRAS, MGMT-Me, MSH2, MSI, NRAS, PGP (MDR-1), PIK3CA, PR, PTEN, ROS1 translocation, RRM1, SPARC, TLE3, TOPO1, TOPO2A, TS, TUBB3, VEGFR2 |
| Colon cancer treatment associated markers | AREG, BRAF, EGFR, EML4-ALK, ERCC1, EREG, KRAS, MSI, NRAS, PIK3CA, PTEN, TS, VEGFR2 |
| Colon cancer treatment associated markers | AREG, BRAF, EGFR, EML4-ALK, ERCC1, EREG, KRAS, MSI, NRAS, PIK3CA, PTEN, TS, VEGFR2 |
| Melanoma treatment associated markers | BRAF, cKIT, ERBB3, ERBB4, ERCC1, GNA11, GNAQ, MGMT, MGMT methylation, NRAS, PIK3CA, TUBB3, VEGFR2 |
| Melanoma treatment associated markers | BRAF, cKIT, ERBB3, ERBB4, ERCC1, GNA11, GNAQ, MGMT-Me, NRAS, PIK3CA, TUBB3, VEGFR2 |
| Ovarian cancer treatment associated markers | BRCA1, cMET, EML4-ALK, ER, ERBB3, ERCC1, KENT-1, HER2, IGF1R, PGP(MDR1), PIK3CA, PR, PTEN, RRM1, TLE3, TOPO1, TOPO2A, TS |
| Ovarian cancer treatment associated markers | BRCA1, cMET, EML4-ALK (translocation), ER, ERBB3, ERCC1, HER2, PIK3CA, PR, PTEN, RRM1, TLE3, TS |
| Breast cancer treatment associated markers | BRAF, BRCA1, EGFR, EGFR T790M, EML4-ALK, ER, ERBB3, ERCC1, HER2, Ki67, PGP (MDR1), PIK3CA, PR, PTEN, ROS1, ROS1 translocation, RRM1, TLE3, TOPO1, TOPO2A, TS |
| Breast cancer treatment associated markers | BRAF, BRCA1, EGFR w/T790M, EML4-ALK, ER, ERBB3, ERCC1, HER2, Ki67, KRAS, PIK3CA, PR, PTEN, ROS1 translocation, RRM1, TLE3, TOPO1, TOPO2A, TS |
| NSCLC cancer treatment associated markers | BRAF, BRCA1, cMET, EGFR, EGFR w/T790M, EML4-ALK, ERCC1, Her2 Exon 20 insert, KRAS, MSH2, PIK3CA, PTEN, ROS1 (trans), RRM1, TLE3, TS, VEGFR2 |
| NSCLC cancer treatment associated markers | BRAF, cMET, EGFR, EGFR w/T790M, EML4-ALK, ERCC1, Her2 Exon 20 insert, KRAS, MSH2, PIK3CA, PTEN, ROS1 translocation, RRM1, TLE3, TS |
| Mutated in cancers | AKT1, ALK, APC, ATM, BRAF, CDH1, CDKN2A, c-Kit, C-Met, CSF1R, CTNNB1, EGFR, ERBB2, ERBB4, FBXW7, FGFR1, FGFR2, FGFR3, FLT3, GNA11, GNAQ, GNAS, HNF1A, HRAS, IDH1, JAK2, JAK3, KDR, KRAS, MLH1, MPL, NOTCH1, NPM1, NRAS, PDGFRA, PIK3CA, PTEN, PTPN11, RB1, RET, SMAD4, SMARCB1, SMO, SRC, STK11, TP53, VHL |

TABLE 4-continued

Illustrative Biomarkers

| Illustrative Class | Biomarkers |
|---|---|
| Mutated in cancers | ALK, BRAF, BRCA1, BRCA2, EGFR, ERRB2, GNA11, GNAQ, IDH1, IDH2, KIT, KRAS,<br>MET, NRAS, PDGFRA, PIK3CA, PTEN, RET, SRC, TP53 |
| Mutated in cancers | AKT1, HRAS, GNAS, MEK1, MEK2, ERK1, ERK2, ERBB3, CDKN2A, PDGFRB, IFG1R,<br>FGFR1, FGFR2, FGFR3, ERBB4, SMO, DDR2, GRB1, PTCH, SHH, PD1, UGT1A1, BIM,<br>ESR1, MLL, AR, CDK4, SMAD4 |
| Mutated in cancers | ABL, APC, ATM, CDH1, CSFR1, CTNNB1, FBXW7, FLT3, HNF1A, JAK2, JAK3, KDR,<br>MLH1, MPL, NOTCH1, NPM1, PTPN11, RB1, SMARCB1, STK11, VHL |
| Mutated in cancers | ABL1, AKT1, AKT2, AKT3, ALK, APC, AR, ARAF, ARFRP1, ARID1A, ARID2, ASXL1,<br>ATM, ATR, ATRX, AURKA, AURKB, AXL, BAP1, BARD1, BCL2, BCL2L2, BCL6,<br>BCOR, BCORL1, BLM, BRAF, BRCA1, BRCA2, BRIP1, BTK, CARD11, CBFB, CBL,<br>CCND1, CCND2, CCND3, CCNE1, CD79A, CD79B, CDC73, CDH1, CDK12, CDK4,<br>CDK6, CDK8, CDKN1B, CDKN2A, CDKN2B, CDKN2C, CEBPA, CHEK1, CHEK2, CIC,<br>CREBBP, CRKL, CRLF2, CSF1R, CTCF, CTNNA1, CTNNB1, DAXX, DDR2, DNMT3A,<br>DOT1L, EGFR, EMSY (C11orf30), EP300, EPHA3, EPHA5, EPHB1, ERBB2, ERBB3,<br>ERBB4, ERG, ESR1, EZH2, FAM123B (WTX), FAM46C, FANCA, FANCC, FANCD2,<br>FANCE, FANCF, FANCG, FANCL, FBXW7, FGF10, FGF14, FGF19, FGF23, FGF3,<br>FGF4, FGF6, FGFR1, FGFR2, FGFR3, FGFR4, FLT1, FLT3, FLT4, FOXL2, GATA1,<br>GATA2, GATA3, GID4 (C17orf39), GNA11, GNA13, GNAQ, GNAS, GPR124, GRIN2A,<br>GSK3B, HGF, HRAS, IDH1, IDH2, IGF1R, IKBKE, IKZF1, IL7R, INHBA, IRF4, IRS2,<br>JAK1, JAK2, JAK3, JUN, KAT6A (MYST3), KDM5A, KDM5C, KDM6A, KDR, KEAP1,<br>KIT, KLHL6, KRAS, LRP1B, MAP2K1, MAP2K2, MAP2K4, MAP3K1, MCL1, MDM2,<br>MDM4, MED12, MEF2B, MEN1, MET, MITF, MLH1, MLL, MLL2, MPL, MRE11A,<br>MSH2, MSH6, MTOR, MUTYH, MYC, MYCL1, MYCN, MYD88, NF1, NF2, NFE2L2,<br>NFKBIA, NKX2-1, NOTCH1, NOTCH2, NPM1, NRAS, NTRK1, NTRK2, NTRK3,<br>NUP93, PAK3, PALB2, PAX5, PBRM1, PDGFRA, PDGFRB, PDK1, PIK3CA, PIK3CG,<br>PIK3R1, PIK3R2, PPP2R1A, PRDM1, PRKAR1A, PRKDC, PTCH1, PTEN, PTPN11,<br>RAD50, RAD51, RAF1, RARA, RB1, RET, RICTOR, RNF43, RPTOR, RUNX1, SETD2,<br>SF3B1, SMAD2, SMAD4, SMARCA4, SMARCB1, SMO, SOCS1, SOX10, SOX2, SPEN,<br>SPOP, SRC, STAG2, STAT4, STK11, SUFU, TET2, TGFBR2, TNFAIP3, TNFRSF14,<br>TOP1, TP53, TSC1, TSC2, TSHR, VHL, WISP3, WT1, XPO1, ZNF217, ZNF703 |
| Gene rearrangement in cancer | ALK, BCR, BCL2, BRAF, EGFR, ETV1, ETV4, ETV5, ETV6, EWSR1, MLL, MYC,<br>NTRK1, PDGFRA, RAF1, RARA, RET, ROS1, TMPRSS2 |
| Cancer Related | ABL1, ACE2, ADA, ADH1C, ADH4, AGT, AKT1, AKT2, AKT3, ALK, APC, AR, ARAF,<br>AREG, ARFRP1, ARID1A, ARID2, ASNS, ASXL1, ATM, ATR, ATRX, AURKA,<br>AURKB, AXL, BAP1, BARD1, BCL2, BCL2L2, BCL6, BCOR, BCORL1, BCR, BIRC5<br>(survivin), BLM, BRAF, BRCA1, BRCA2, BRIP1, BTK, CA2, CARD11, CAV, CBFB,<br>CBL, CCND1, CCND2, CCND3, CCNE1, CD33, CD52 (CDW52), CD79A, CD79B,<br>CDC73, CDH1, CDK12, CDK2, CDK4, CDK6, CDK8, CDKN1B, CDKN2A, CDKN2B,<br>CDKN2C, CEBPA, CES2, CHEK1, CHEK2, CIC, CREBBP, CRKL, CRLF2, CSF1R,<br>CTCF, CTNNA1, CTNNB1, DAXX, DCK, DDR2, DHFR, DNMT1, DNMT3A, DNMT3B,<br>DOT1L, EGFR, EMSY (C11orf30) , EP300, EPHA2, EPHA3, EPHA5, EPHB1, ERBB2,<br>ERBB3, ERBB4, ERBB2 (typo?), ERCC3, EREG, ERG, ESR1, ETV1, ETV4, ETV5, ETV6,<br>EWSR1, EZH2, FAM123B (WTX), FAM46C, FANCA, FANCC, FANCD2, FANCE,<br>FANCF, FANCG, FANCL, FBXW7, FGF10, FGF14, FGF19, FGF2, FGF3, FGF4, FGF6,<br>FGFR1, FGFR2, FGFR3, FGFR4, FLT1, FLT3, FLT4, FOLR1, FOLR2, FOXL2, FSHB,<br>FSHPRH1, FSHR, GART, GATA1, GATA2, GATA3, GID4 (C17orf39), GNA11, GNA13,<br>GNAQ, GNAS, GNRH1, GNRHR1, GPR124, GRIN2A, GSK3B, GSTP1, HDAC1, HGF,<br>HIG1, HNF1A, HRAS, HSPCA (HSP90), IDH1, IDH2, IGF1R, IKBKE, IKZF1, IL13RA1,<br>IL2, IL2RA (CD25), IL7R, INHBA, IRF4, IRS2, JAK1, JAK2, JAK3, JUN, KAT6A<br>(MYST3), KDM5A, KDM5C, KDM6A, KDR (VEGFR2), KEAP1, KIT, KLHL6, KRAS,<br>LCK, LRP1B, LTB, LTBR, MAP2K1, MAP2K2, MAP2K4, MAP3K1, MAPK, MCL1,<br>MDM2, MDM4, MED12, MEF2B, MEN1, MET, MGMT, MITF, MLH1, MLL, MLL2,<br>MPL, MRE11A, MS4A1 (CD20), MSH2, MSH6, MTAP, MTOR, MUTYH, MYC, MYCL1,<br>MYCN, MYD88, NF1, NF2, NFE2L2, NFKB1, NFKB2, NFKBIA, NGF, NKX2-1,<br>NOTCH1, NOTCH2, NPM1, NRAS, NTRK1, NTRK2, NTRK3, NUP93, ODC1, OGFR,<br>PAK3, PALB2, PAX5, PBRM1, PDGFC, PDGFRA, PDGFRB, PDK1, PGP, PGR (PR),<br>PIK3CA, PIK3CG, PIK3R1, PIK3R2, POLA, PPARG, PPARGC1, PPP2R1A, PRDM1,<br>PRKAR1A, PRKDC, PTCH1, PTEN, PTPN11, RAD50, RAD51, RAF1, RARA, RBI, RET,<br>RICTOR, RNF43, ROS1, RPTOR, RRM1, RRM2, RRM2B, RUNX1, RXR, RXRB, RXRG,<br>SETD2, SF3B1, SMAD2, SMAD4, SMARCA4, SMARCB1, SMO, SOCS1, SOX10, SOX2,<br>SPARC, SPEN, SPOP, SRC, SST, SSTR1, SSTR2, SSTR3, SSTR4, SSTR5, STAG2,<br>STAT4, STK11, SUFU , TET2, TGFBR2, TK1, TLE3, TMPRSS2, TNF, TNFAIP3,<br>TNFRSF14, TOP1, TOP2, TOP2A, TOP2B, TP53, TS, TSC1, TSC2, TSHR, TUBB3, TXN,<br>TYMP, VDR, VEGF (VEGFA), VEGFC, VHL, WISP3, WT1, XDH, XPO1, YES1, ZAP70,<br>ZNF217, ZNF703 |

TABLE 4-continued

Illustrative Biomarkers

| Illustrative Class | Biomarkers |
|---|---|
| Cytohesions | cytohesin-1 (CYTH1), cytohesin-2 (CYTH2; ARNO), cytohesin-3 (CYTH3; Grp1; ARNO3), cytohesin-4 (CYTH4) |
| Cancer/Angio | Erb 2, Erb 3, Erb 4, UNC93a, B7H3, MUC1, MUC2, MUC16, MUC17, 5T4, RAGE, VEGF A, VEGFR2, FLT1, DLL4, Epcam |
| Tissue (Breast) | BIG H3, GCDFP-15, PR(B), GPR 30, CYFRA 21, BRCA 1, BRCA 2, ESR 1, ESR2 |
| Tissue (Prostate) | PSMA, PCSA, PSCA, PSA, TMPRSS2 |
| Inflammation/Immune | MFG-E8, IFNAR, CD40, CD80, MICE, HLA-DRb, IL-17-Ra |
| Common vesicle markers | HSPA8, CD63, Actb, GAPDH, CD9, CD81, ANXA2, HSP9OAA1, ENO1, YWHAZ, PDCD6IP, CFL1, SDCBP, PKN2, MSN, MFGE8, EZR, YWHAG, PGK1, EEF1A1, PPIA, GLC1F, GK, ANXA6, ANXA1, ALDOA, ACTG1, TPI1, LAMP2, HSP90AB1, DPP4, YWHAB, TSG101, PFN1, LDHB, HSPA1B, HSPA1A, GSTP1, GNAI2, GDI2, CLTC, ANXA5, YWHAQ, TUBA1A, THBS1, PRDX1, LDHA, LAMP1, CLU, CD86 |
| Common vesicle membrane markers | CD63, GAPDH, CD9, CD81, ANXA2, ENO1, SDCBP, MSN, MFGE8, EZR, GK, ANXA1, LAMP2, DPP4, TSG101, HSPA1A, GDI2, CLTC, LAMP1, CD86, ANPEP, TFRC, SLC3A2, RDX, RAP1B, RABSC, RABSB, MYH9, ICAM1, FN1, RAB11B, PIGR, LGALS3, ITGB1, EHD1, CLIC1, ATP1A1, ARF1, RAP1A, P4HB, MUC1, KRT10, HLA-A, FLOT1, CD59, C1orf58, BASP1, TACSTD1, STOM |
| Common vesicle markers | MHC class I, MHC class II, Integrins, Alpha 4 beta 1, Alpha M beta 2, Beta 2, ICAM1/CD54, P-selection, Dipeptidylpeptidase IV/CD26, Aminopeptidase n/CD13, CD151, CD53, CD37, CD82, CD81, CD9, CD63, Hsp70, Hsp84/90 Actin, Actin-binding proteins, Tubulin, Annexin I, Annexin II, Annexin IV, Annexin V, Annexin VI, RAB7/RAP1B/RADGDI, Gi2alpha/14-3-3, CBL/LCK, CD63, GAPDH, CD9, CD81, ANXA2, ENO1, SDCBP, MSN, MFGE8, EZR, GK, ANXA1, LAMP2, DPP4, TSG101, HSPA1A, GDI2, CLTC, LAMP1, Cd86, ANPEP, TFRC, SLC3A2, RDX, RAP1B, RAB5C, RAB5B, MYH9, ICAM1, FN1, RAB11B, PIGR, LGALS3, ITGB1, EHD1, CLIC1, ATP1A1, ARF1, RAP1A, P4HB, MUC1, KRT10, HLA-A, FLOT1, CD59, C1orf58, BASP1, TACSTD1, STOM |
| Vesicle markers | A33, a33 n15, AFP, ALA, ALIX, ALP, AnnexinV, APC, ASCA, ASPH (246-260), ASPH (666-680), ASPH (A-10), ASPH (D01P), ASPH (D03), ASPH (G-20), ASPH (H-300), AURKA, AURKB, B7H3, B7H4, BCA-225, BCNP, BDNF, BRCA, CA125 (MUC16), CA-19-9, C-Bir, CD1.1, CD10, CD174 (Lewis y), CD24, CD44, CD46, CD59 (MEM-43), CD63, CD66e CEA, CD73, CD81, CD9, CDA, CDAC1 1a2, CEA, C-Erb2, C-erbB2, CRMP-2, CRP, CXCL12, CYFRA21-1, DLL4, DR3, EGFR, Epcam, EphA2, EphA2 (H-77), ER, ErbB4, EZH2, FASL, FRT, FRT c.f23, GDF15, GPCR, GPR30, Gro-alpha, HAP, HBD 1, HBD2, HER 3 (ErbB3), HSP, HSP70, hVEGFR2, iC3b, IL 6 Unc, IL-1B, IL6 Unc, IL6R, IL8, IL-8, INSIG-2, KLK2, L1CAM, LAMN, LDH, MACC-1, MAPK4, MART-1, MCP-1, M-CSF, MFG-E8, MIC1, MIF, MIS RII, MMG, MMP26, MMPI, MMP9, MS4A1, MUC1, MUC1 seq1, MUC1 seq11A, MUC17, MUC2, Ncam, NGAL, NPGP/NPFF2, OPG, OPN, p53, p53, PA2G4, PBP, PCSA, PDGFRB, PGP9.5, PIM1, PR (B), PRL, PSA, PSMA, PSME3, PTEN, R5-CD9 Tube 1, Reg IV, RUNX2, SCRN1, seprase, SERPINB3, SPARC, SPB, SPDEF, SRVN, STAT 3, STEAP1, TF (FL-295), TFF3, TGM2, TIMP-1, TIMP1, TIMP2, TMEM211, TMPRSS2, TNF-alpha, Trail-R2, Trail-R4, TrKB, TROP2, Tsg 101, TWEAK, UNC93A, VEGF A, YPSMA-1 |
| Vesicle markers | NSE, TRIM29, CD63, CD151, ASPH, LAMP2, TSPAN1, SNAIL, CD45, CKS1, NSE, FSHR, OPN, FTH1, PGP9, ANNEXIN 1, SPD, CD81, EPCAM, PTH1R, CEA, CYTO 7, CCL2, SPA, KRAS, TWIST1, AURKB, MMP9, P27, MMP1, HLA, HIF, CEACAM, CENPH, BTUB, INTG b4, EGFR, NACC1, CYTO 18, NAP2, CYTO 19, ANNEXIN V, TGM2, ERB2, BRCA1, B7H3, SFTPC, PNT, NCAM, MS4A1, P53, INGA3, MUC2, SPA, OPN, CD63, CD9, MUC1, UNCR3, PAN ADH, HCG, TIMP, PSMA, GPCR, RACK1, PSCA, VEGF, BMP2, CD81, CRP, PRO GRP, B7H3, MUC1, M2PK, CD9, PCSA, PSMA |
| Vesicle markers | TFF3, MS4A1, EphA2, GAL3, EGFR, N-gal, PCSA, CD63, MUC1, TGM2, CD81, DR3, MACC-1, TrKB, CD24, TIMP-1, A33, CD66 CEA, PRL, MMP9, MMP7, TMEM211, SCRN1, TROP2, TWEAK, CDACC1, UNC93A, APC, C-Erb, CD10, BDNF, FRT, GPR30, P53, SPR, OPN, MUC2, GRO-1, tsg 101, GDF15 |
| Vesicle markers | CD9, Erb2, Erb4, CD81, Erb3, MUC16, CD63, DLL4, HLA-Drpe, B7H3, IFNAR, 5T4, PCSA, MICB, PSMA, MFG-E8, Muc1, PSA, Muc2, Unc93a, VEGFR2, EpCAM, VEGF A, TMPRSS2, RAGE, PSCA, CD40, Muc17, IL-17-RA, CD80 |
| Benign Prostate Hyperplasia (BPH) | BCMA, CEACAM-1, HVEM, IL-1 R4, IL-10 Rb, Trappin-2, p53, hsa-miR-329, hsa-miR-30a, hsa-miR-335, hsa-miR-152, hsa-miR-151-5p, hsa-miR-200a, hsa-miR-145, hsa-miR-29a, hsa-miR-106b, hsa-miR-595, hsa-miR-142-5p, hsa-miR-99a, hsa-miR-20b, hsa-miR-373, hsa-miR-502-5p, hsa-miR-29b, hsa-miR-142-3p, hsa-miR-663, hsa-miR-423-5p, hsa-miR-15a, hsa-miR-888, hsa-miR-361-3p, hsa-miR-365, hsa-miR-10b, hsa-miR-199a-3p, hsa-miR-181a, hsa-miR-19a, hsa-miR-125b, hsa-miR-760, hsa-miR-7a, hsa-miR-671-5p, hsa-miR-7c, hsa-miR-1979, hsa-miR-103 |
| Metastatic Prostate Cancer | hsa-miR-100, hsa-miR-1236, hsa-miR-1296, hsa-miR-141, hsa-miR-146b-5p, hsa-miR-17*, hsa-miR-181a, hsa-miR-200b, hsa-miR-20a*, hsa-miR-23a*, hsa-miR-331-3p, hsa-miR-375, hsa-miR-452, hsa-miR-572, hsa-miR-574-3p, hsa-miR-577, hsa-miR-582-3p, hsa-miR-937, miR-10a, miR-134, miR-141, miR-200b, miR-30a, miR-32, miR-375, miR-495, miR-564, miR-570, miR-574-3p, miR-885-3p |

TABLE 4-continued

Illustrative Biomarkers

| Illustrative Class | Biomarkers |
|---|---|
| Metastatic Prostate Cancer | hsa-miR-200b, hsa-miR-375, hsa-miR-141, hsa-miR-331-3p, hsa-miR-181a, hsa-miR-574-3p |
| Prostate Cancer | hsa-miR-574-3p, hsa-miR-141, hsa-miR-432, hsa-miR-326, hsa-miR-2110, hsa-miR-181a-2*, hsa-miR-107, hsa-miR-301a, hsa-miR-484, hsa-miR-625* |
| Metastatic Prostate Cancer | hsa-miR-582-3p, hsa-miR-20a*, hsa-miR-375, hsa-miR-200b, hsa-miR-379, hsa-miR-572, hsa-miR-513a-5p, hsa-miR-577, hsa-miR-23a*, hsa-miR-1236, hsa-miR-609, hsa-miR-17*, hsa-miR-130b, hsa-miR-619, hsa-miR-624*, hsa-miR-198 |
| Metastatic Prostate Cancer | FOX01A, SOX9, CLNS1A, PTGDS, XPO1, LETMD1, RAD23B, ABCC3, APC, CHES1, EDNRA, FRZB, HSPG2, TMPRSS2_ETV1 fusion |
| Prostate Cancer | hsa-let-7b, hsa-miR-107, hsa-miR-1205, hsa-miR-1270, hsa-miR-130b, hsa-miR-141, hsa-miR-143, hsa-miR-148b*, hsa-miR-150, hsa-miR-154*, hsa-miR-181a*, hsa-miR-181a-2*, hsa-miR-18a*, hsa-miR-19b-1*, hsa-miR-204, hsa-miR-2110, hsa-miR-215, hsa-miR-217, hsa-miR-219-2-3p, hsa-miR-23b*, hsa-miR-299-5p, hsa-miR-301a, hsa-miR-301a, hsa-miR-326, hsa-miR-331-3p, hsa-miR-365*, hsa-miR-373*, hsa-miR-424, hsa-miR-424*, hsa-miR-432, hsa-miR-450a, hsa-miR-451, hsa-miR-484, hsa-miR-497, hsa-miR-517*, hsa-miR-517a, hsa-miR-518f, hsa-miR-574-3p, hsa-miR-595, hsa-miR-617, hsa-miR-625*, hsa-miR-628-5p, hsa-miR-629, hsa-miR-634, hsa-miR-769-5p, hsa-miR-93, hsa-miR-96 |
| Prostate Cancer | CD9, PSMA, PCSA, CD63, CD81, B7H3, IL 6, OPG-13, IL6R, PA2G4, EZH2, RUNX2, SERPINB3, EpCam |
| Prostate Cancer | A33, a33 n15, AFP, ALA, ALIX, ALP, AnnexinV, APC, ASCA, ASPH (246-260), ASPH (666-680), ASPH (A-10), ASPH (DO1P), ASPH (D03), ASPH (G-20), ASPH (H-300), AURKA, AURKB, B7H3, B7H4, BCA-225, BCNP, BDNF, BRCA, CA125 (MUC16), CA-19-9, C-Bir, CD1.1, CD10, CD174 (Lewis y), CD24, CD44, CD46, CD59 (MEM-43), CD63, CD66e CEA, CD73, CD81, CD9, CDA, CDAC1 1a2, CEA, C-Erb2, C-erbB2, CRMP-2, CRP, CXCL12, CYFRA21-1, DLL4, DR3, EGFR, Epcam, EphA2, EphA2 (H-77), ER, ErbB4, EZH2, FASL, FRT, FRT c.f23, GDF15, GPCR, GPR30, Gro-alpha, HAP, HBD 1, HBD2, HER 3 (ErbB3), HSP, HSP70, hVEGFR2, iC3b, IL 6 Unc, IL-1B, IL6 Unc, IL6R, IL8, IL-8, INSIG-2, KLK2, L1CAM, LAMN, LDH, MACC-1, MAPK4, MART-1, MCP-1, M-CSF, MFG-E8, MIC1, MIF, MIS RII, MMG, MMP26, MMP7, MMP9, MS4A1, MUC1, MUC1 seq1, MUC1 seq11A, MUC17, MUC2, Ncam, NGAL, NPGP/NPFF2, OPG, OPN, p53, p53, PA2G4, PBP, PCSA, PDGFRB, PGP9.5, PIM1, PR (B), PRL, PSA, PSMA, PSME3, PTEN, R5-CD9 Tube 1, Reg IV, RUNX2, SCRN1, seprase, SERPINB3, SPARC, SPB, SPDEF, SRVN, STAT 3, STEAP1, TF (FL-295), TFF3, TGM2, TIMP-1, TIMP1, TIMP2, TMEM211, TMPRSS2, TNF-alpha, Trail-R2, Trail-R4, TrKB, TROP2, Tsg 101, TWEAK, UNC93A, VEGF A, YPSMA-1 |
| Prostate Cancer Vesicle Markers | 5T4, ACTG1, ADAM10, ADAM15, ALDOA, ANXA2, ANXA6, APOA1, ATP1A1, BASP1, C1orf58, C20orf114, C8B, CAPZA1, CAV1, CD151, CD2AP, CD59, CD9, CD9, CFL1, CFP, CHMP4B, CLTC, COTL1, CTNND1, CTSB, CTSZ, CYCS, DPP4, EEF1A1, EHD1, ENO1, F11R, F2, F5, FAM125A, FNBP1L, FOLH1, GAPDH, GLB1, GPX3, HIST1H1C, HIST1H2AB, HSP90AB1, HSPA1B, HSPA8, IGSF8, ITGB1, ITIH3, JUP, LDHA, LDHB, LUM, LYZ, MFGE8, MGAM, MMP9, MYH2, MYL6B, NME1, NME2, PABPC1, PABPC4, PACSIN2, PCBP2, PDCD6IP, PRDX2, PSA, PSMA, PSMA1, PSMA2, PSMA4, PSMA6, PSMA7, PSMB1, PSMB2, PSMB3, PSMB4, PSMB5, PSMB6, PSMB8, PTGFRN, RPS27A, SDCBP, SERINC5, SH3GL1, SLC3A2, SMPDL3B, SNX9, TACSTD1, TCN2, THBS1, TPI1, TSG101, TUBB, VDAC2, VPS37B, YWHAG, YWHAQ, YWHAZ |
| Prostate Cancer Vesicle Markers | FLNA, DCRN, HER 3 (ErbB3), VCAN, CD9, GAL3, CDADC1, GM-CSF, EGFR, RANK, CSA, PSMA, ChickenIgY, B7H3, PCSA, CD63, CD3, MUC1, TGM2, CD81, S100-A4, MFG-E8, Integrin, NK-2R(C-21), PSA, CD24, TIMP-1, IL6 Unc, PBP, PIM1, CA-19-9, Trail-R4, MMP9, PRL, EphA2, TWEAK, NY-ESO-1, Mammaglobin, UNC93A, A33, AURKB, CD41, XAGE-1, SPDEF, AMACR, seprase/FAP, NGAL, CXCL12, FRT, CD66e CEA, SIM2 (C-15), C-Bir, STEAP, PSIP1/LEDGF, MUC17, hVEGFR2, ERG, MUC2, ADAM10, ASPH (A-10), CA125, Gro-alpha, Tsg 101, SSX2, Trail-R4 |
| Prostate Cancer Vesicle Markers | NT5E (CD73), A33, ABL2, ADAM10, AFP, ALA, ALIX, ALPL, AMACR, Apo J/CLU, ASCA, ASPH (A-10), ASPH (D01P), AURKB, B7H3, B7H4, BCNP, BDNF, CA125 (MUC16), CA-19-9, C-Bir (Flagellin), CD10, CD151, CD24, CD3, CD41, CD44, CD46, CD59(MEM-43), CD63, CD66e CEA, CD81, CD9, CDA, CDADC1, C-erbB2, CRMP-2, CRP, CSA, CXCL12, CXCR3, CYFRA21-1, DCRN, DDX-1, DLL4, EGFR, EpCAM, EphA2, ERG, EZH2, FASL, FLNA, FRT, GAL3, GATA3, GM-CSF, Gro-alpha, HAP, HER3 (ErbB3), HSP70, HSPB1, hVEGFR2, iC3b, IL-1B, IL6 R, IL6 Unc, IL7 R alpha/CD127, IL8, INSIG-2, Integrin, KLK2, Label, LAMN, Mammaglobin, M-CSF, MFG-E8, MIF, MIS RH, MMP7, MMP9, MS4A1, MUC1, MUC17, MUC2, Ncam, NDUFB7, NGAL, NK-2R(C-21), NY-ESO-1, p53, PBP, PCSA, PDGFRB, PIM1, PRL, PSA, PSIP1/LEDGF, PSMA, RAGE, RANK, Reg IV, RUNX2, S100-A4, seprase/FAP, SERPINB3, SIM2 (C-15), SPARC, SPC, SPDEF, SPP1, SSX2, SSX4, STEAP, STEAP4, TFF3, TGM2, TIMP-1, TMEM211, Trail-R2, Trail-R4, TrKB (poly), Trop2, Tsg 101, TWEAK, UNC93A, VCAN, VEGF A, wnt-5a(C-16), XAGE, XAGE-1 |
| Prostate Vesicle Membrane | ADAM 9, ADAM10, AGR2, ALDOA, ALIX, ANXA1, ANXA2, ANXA4, ARF6, ATP1A3, B7H3, BCHE, BCL2L14 (Bcl G), BCNP1, BDKRB2, BDNFCAV1-Caveolin1, CCR2 (CC chemokine receptor 2, CD192), CCR5 (CC chemokine receptor 5), CCT2 (TCP1-beta), CD10, CD151, CD166/ALCAM, CD24, CD283/TLR3, CD41, CD46, CD49d (Integrin alpha |

TABLE 4-continued

Illustrative Biomarkers

| Illustrative Class | Biomarkers |
|---|---|
| | 4, ITGA4), CD63, CD81, CD9, CD90/THY1, CDH1, CDH2, CDKN1A cyclin-dependent kinase inhibitor (p21), CGA gene (coding for the alpha subunit of glycoprotein hormones), CLDN3- Claudin3, COX2 (PTGS2), CSE1L (Cellular Apoptosis Susceptibility), CXCR3, Cytokeratin 18, Eag1 (KCNH1), EDIL3 (del-1), EDNRB - Endothelial Receptor Type B, EGFR, EpoR, EZH2 (enhancer of Zeste Homolog2), EZR, FABP5, Farnesyltransferase/geranylgeranyl diphosphate synthase 1 (GGPS1), Fatty acid synthase (FASN), FTL (light and heavy), GAL3, GDF15-Growth Differentiation Factor 15, GloI, GM-CSF, GSTP1, H3F3A, HGF (hepatocyte growth factor), hK2/Kif2a, HSP9OAA1, HSPA1A/HSP70-1, HSPB1, IGFBP-2, IGFBP-3, IL1alpha, IL-6, IQGAP1, ITGAL (Integrin alpha L chain), Ki67, KLK1, KLK10, KLK11, KLK12, KLK13, KLK14, KLK15, KLK4, KLK5, KLK6, KLK7, KLK8, KLK9, Lamp-2, LDH-A, LGALS3BP, LGALS8, MMP 1, MMP 2, MMP 25, MMP 3, MMP10, MMP-14/MT1-MMP, MMP7, MTA1nAnS, Nav1.7, NKX3-1, Notch1, NRP1/CD304, PAP (ACPP), PGP, PhIP, PIP3/BPNT1, PKM2, PKP1 (plakophilin1), PKP3 (plakophilin3), Plasma chromogranin-A (CgA), PRDX2, Prostate secretory protein (PSP94)/β-Microseminoprotein (MSP)/IGBF, PSAP, PSMA, PSMA1, PTENPTPN13/PTPL1, RPL19, seprase/FAP SET, SLC3A2/CD98, SRVN, STEAP1, Syndecan/CD138, TGFB, TGM2, TIMP-1TLR4 (CD284), TLR9 (CD289), TMPRSS1/hepsin, TMPRSS2, TNFR1, TNFα, Transferrin receptor/CD71/TRFR, Trop2 (TACSTD2), TWEAK uPA (urokinase plasminoge activator) degrades extracellular matrix, uPAR (uPA receptor)/CD87, VEGFR1, VEGFR2 |
| Prostate Vesicle Markers | ADAM 34, ADAM 9, AGR2, ALDOA, ANXA1, ANXA 11, ANXA4, ANXA 7, ANXA2, ARF6, ATP1A1, ATP1A2, ATP1A3, BCHE, BCL2L14 (Bcl G), BDKRB2, CA215, CAV1-Caveolinl, CCR2 (CC chemokine receptor 2, CD192), CCR5 (CC chemokine receptor 5), CCT2 (TCP1-beta), CD166/ALCAM, CD49b (Integrin alpha 2, ITGA4), CD90/THY1, CDH1, CDH2, CDKN1A cyclin-dependent kinase inhibitor (p21), CGA gene (coding for the alpha subunit of glycoprotein hormones), CHMP4B, CLDN3- Claudin3, CLSTN1 (Calsyntenin-1), COX2 (PTGS2), CSE1L (Cellular Apoptosis Susceptibility), Cytokeratin 18, Eag1 (KCNH1) (plasma membrane-K+-voltage gated channel), EDIL3 (del-1), EDNRB-Endothelial Receptor Type B, Endoglin/CD105, ENOX2-Ecto-NOX disulphide Thiol exchanger 2, EPCA-2 Early prostate cancer antigen2, EpoR, EZH2 (enhancer of Zeste Homolog2), EZR, FABP5, Farnesyltransferase/geranylgeranyl diphosphate synthase 1 (GGPS1), Fatty acid synthase (FASN, plasma membrane protein), FTL (light and heavy), GDF15-Growth Differentiation Factor 15, GloI, GSTP1, H3F3A, HGF (hepatocyte growth factor), hK2 (KLK2), HSP90AA1, HSPA1A/HSP70-1, IGFBP-2, IGFBP-3, IL1alpha, IL-6, IQGAP1, ITGAL (Integrin alpha L chain), Ki67, KLK1, KLK10, KLK11, KLK12, KLK13, KLK14, KLK15, KLK4, KLK5, KLK6, KLK7, KLK8, KLK9, Lamp-2, LDH-A, LGALS3BP, LGALS8, MFAP5, MMP 1, MMP 2, MMP 24, MMP 25, MMP 3, MMP10, MMP-14/MT1-MMP, MTA1, nAnS, Nav1.7, NCAM2—Neural cell Adhesion molecule 2, NGEP/D-TMPP/IPCA-5/ANO7, NKX3-1, Notch1, NRP1/CD304, PGP, PAP (ACPP), PCA3—Prostate cancer antigen 3, Pdia3/ERp57, PhIP, phosphatidylethanolamine (PE), PIP3, PKP1 (plakophilin1), PKP3 (plakophilin3), Plasma chromogranin-A (CgA), PRDX2, Prostate secretory protein (PSP94)/β-Microseminoprotein (MSP)/IGBF, PSAP, PSMA1, PTEN, PTGFRN, PTPN13/PTPL1, PKM2, RPL19, SCA-1/ATXN1, SERINC5/TPO1, SET, SLC3A2/CD98, STEAP1, STEAP-3, SRVN, Syndecan/CD138, TGFB, Tissue Polypeptide Specific antigen TPS, TLR4 (CD284), TLR9 (CD289), TMPRSS1/hepsin, TMPRSS2, TNFR1, TNFa, CD283/TLR3, Transferrin receptor/CD71/TRFR, uPA (urokinase plasminoge activator) , uPAR (uPA receptor)/CD87, VEGFR1, VEGFR2 |
| Prostate Cancer Treatment | hsa-miR-1974, hsa-miR-27b, hsa-miR-103, hsa-miR-146a, hsa-miR-22, hsa-miR-382, hsa-miR-23a, hsa-miR-376c, hsa-miR-335, hsa-miR-142-5p, hsa-miR-221, hsa-miR-142-3p, hsa-miR-151-3p, hsa-miR-21, hsa-miR-16 |
| Prostate Cancer | let-7d, miR-148a, miR-195, miR-25, miR-26b, miR-329, miR-376c, miR-574-3p, miR-888, miR-9, miR1204, miR-16-2*, miR-497, miR-588, miR-614, miR-765, miR92b*, miR-938, let-7f-2*, miR-300, miR-523, miR-525-5p, miR-1182, miR-1244, miR-520d-3p, miR-379, let-7b, miR-125a-3p, miR-1296, miR-134, miR-149, miR-150, miR-187, miR-32, miR-324-3p, miR-324-5p, miR-342-3p, miR-378, miR-378*, miR-384, miR-451, miR-455-3p, miR-485-3p, miR-487a, miR-490-3p, miR-502-5p, miR-548a-5p, miR-550, miR-562, miR-593, miR-593*, miR-595, miR-602, miR-603, miR-654-5p, miR-877*, miR-886-5p, miR-125a-5p, miR-140-3p, miR-192, miR-196a, miR-2110, miR-212, miR-222, miR-224*, miR-30b*, miR-499-3p, miR-505* |
| Prostate (PCSA+ cMVs) | miR-182, miR-663, miR-155, mirR-125a-5p, miR-548a-5p, miR-628-5p, miR-517*, miR-450a, miR-920, hsa-miR-619, miR-1913, miR-224*, miR-502-5p, miR-888, miR-376a, miR-542-5p, miR-30b*, miR-1179 |
| Prostate Cancer | miR-183-96-182 cluster (miRs-183, 96 and 182), metal ion transporter such as hZIP1, SLC39A1, SLC39A2, SLC39A3, SLC39A4, SLC39A5, SLC39A6, SLC39A7, SLC39A8, SLC39A9, SLC39A10, SLC39A11, SLC39Al2, SLC39A13, SLC39A14 |
| Prostate Cancer | RAD23B, FBP1, TNFRSF1A, CCNG2, NOTCH3, ETV1, BID, SIM2, LETMD1, ANXA1, miR-519d, miR-647 |

TABLE 4-continued

Illustrative Biomarkers

| Illustrative Class | Biomarkers |
|---|---|
| Prostate Cancer | RAD23B, FBP1, TNFRSF1A, NOTCH3, ETV1, BID, SIM2, ANXA1, BCL2 |
| Prostate Cancer | ANPEP, ABL1, PSCA, EFNA1, HSPB1, INMT, TRIP13 |
| Prostate Cancer | E2F3, c-met, pRB, EZH2, e-cad, CAXII, CAIX, HIF-1α, Jagged, PIM-1, hepsin, RECK, Clusterin, MMP9, MTSP-1, MMP24, MMP15, IGFBP-2, IGFBP-3, E2F4, caveolin, EF-1A, Kallikrein 2, Kallikrein 3, PSGR |
| Prostate Cancer | A2ML1, BAX, C10orf47, C1orf162, CSDA, EIFC3, ETFB, GABARAPL2, GUK1, GZMH, HIST1H3B, HLA-A, HSP90AA1, NRGN, PRDX5, PTMA, RABAC1, RABAGAP1L, RPL22, SAP18, SEPW1, SOX1 |
| Prostate Cancer | NY-ESO-1, SSX-2, SSX-4, XAGE-lb, AMACR, p90 autoantigen, LEDGF |
| Prostate Cancer | A33, ABL2, ADAM10, AFP, ALA, ALIX, ALPL, ApoJ/CLU, ASCA, ASPH(A-10), ASPH(D01P), AURKB, B7H3, B7H3, B7H4, BCNP, BDNF, CA125(MUC16), CA-19-9, C-Bir, CD10, CD151, CD24, CD41, CD44, CD46, CD59(MEM-43), CD63, CD63, CD66eCEA, CD81, CD81, CD9, CD9, CDA, CDADC1, CRMP-2, CRP, CXCL12, CXCR3, CYFRA21-1, DDX-1, DLL4, DLL4, EGFR, Epcam, EphA2, ErbB2, ERG, EZH2, FASL, FLNA, FRT, GAL3, GATA2, GM-CSF, Gro-alpha, HAP, HER3(ErbB3), HSP70, HSPB1, hVEGFR2, iC3b, IL-1B, IL6R, IL6Unc, IL7Ralpha/CD127, IL8, INSIG-2, Integrin, KLK2, LAMN, Mammoglobin, M-CSF, MFG-E8, MIF, MISRII, MMP7, MMP9, MUC1, Muc1, MUC17, MUC2, Ncam, NDUFB7, NGAL, NK-2R(C-21), NT5E (CD73), p53, PBP, PCSA, PCSA, PDGFRB, PIM1, PRL, PSA, PSA, PSMA, PSMA, RAGE, RANK, RegIV, RUNX2, S100-A4, seprase/FAP, SERPINB3, SIM2(C-15), SPARC, SPC, SPDEF, SPP1, STEAP, STEAP4, TFF3, TGM2, TIMP-1, TMEM211, Trail-R2, Trail-R4, TrKB(poly), Trop2, Tsg101, TWEAK, UNC93A, VEGFA, wnt-5a(C-16) |
| Prostate Vesicles | CD9, CD63, CD81, PCSA, MUC2, MFG-E8 |
| Prostate Cancer | miR-148a, miR-329, miR-9, miR-378*, miR-25, miR-614, miR-518c*, miR-378, miR-765, let-7f-2*, miR-574-3p, miR-497, miR-32, miR-379, miR-520g, miR-542-5p, miR-342-3p, miR-1206, miR-663, miR-222 |
| Prostate Cancer | hsa-miR-877*, hsa-miR-593, hsa-miR-595, hsa-miR-300, hsa-miR-324-5p, hsa-miR-548a-5p, hsa-miR-329, hsa-miR-550, hsa-miR-886-5p, hsa-miR-603, hsa-miR-490-3p, hsa-miR-938, hsa-miR-149, hsa-miR-150, hsa-miR-1296, hsa-miR-384, hsa-miR-487a, hsa-miRPlus-C1089, hsa-miR-485-3p, hsa-miR-525-5p |
| Prostate Cancer | hsa-miR-451, hsa-miR-223, hsa-miR-593*, hsa-miR-1974, hsa-miR-486-5p, hsa-miR-19b, hsa-miR-320b, hsa-miR-92a, hsa-miR-21, hsa-miR-675*, hsa-miR-16, hsa-miR-876-5p, hsa-miR-144, hsa-miR-126, hsa-miR-137, hsa-miR-1913, hsa-miR-29b-1*, hsa-miR-15a, hsa-miR-93, hsa-miR-1266 |
| Inflammatory Disease | miR-588, miR-1258, miR-16-2*, miR-938, miR-526b, miR-92b*, let-7d, miR-378*, miR-124, miR-376c, miR-26b, miR-1204, miR-574-3p, miR-195, miR-499-3p, miR-2110, miR-888 |
| Prostate Cancer | A33, ADAM10, AMACR, ASPH (A-10), AURKB, B7H3, CA125, CA-19-9, C-Bir, CD24, CD3, CD41, CD63, CD66e CEA, CD81, CD9, CDADC1, CSA, CXCL12, DCRN, EGFR, EphA2, ERG, FLNA, FRT, GAL3, GM-CSF, Gro-alpha, HER 3 (ErbB3), hVEGFR2, IL6 Unc, Integrin, Mammaglobin, MFG-E8, MMP9, MUC1, MUC17, MUC2, NGAL, NK-2R (C-21), NY-ESO-1, PBP, PCSA, PIM1, PRL, PSA, PSIP1/LEDGF, PSMA, RANK, S100-A4, seprase/FAP, SIM2 (C-15), SPDEF, SSX2, STEAP, TGM2, TIMP-1, Trail-R4, Tsg 101, TWEAK, UNC93A, VCAN, XAGE-1 |
| Prostate Cancer | A33, ADAM10, ALIX, AMACR, ASCA, ASPH (A-10), AURKB, B7H3, BCNP, CA125, CA-19-9, C-Bir (Flagellin), CD24, CD3, CD41, CD63, CD66e CEA, CD81, CD9, CDADC1, CRP, CSA, CXCL12, CYFRA21-1, DCRN, EGFR, EpCAM, EphA2, ERG, FLNA, GAL3, GATA2, GM-CSF, Gro alpha, HER3 (ErbB3), HSP70, hVEGFR2, iC3b, IL-1B, IL6 Unc, IL8, Integrin, KLK2, Mammaglobin, MFG-E8, MMP7, MMP9, MS4A1, MUC1, MUC17, MUC2, NGAL, NK-2R(C-21), NY-ESO-1, p53, PBP, PCSA, PIM1, PRL, PSA, PSMA, RANK, RUNX2, S100-A4, seprase/FAP, SERPINB3, SIM2 (C-15), SPC, SPDEF, SSX2, SSX4, STEAP, TGM2, TIMP-1, TRAIL R2, Trail-R4, Tsg 101, TWEAK, VCAN, VEGF A, XAGE |
| Prostate Vesicles | EpCam, CD81, PCSA, MUC2, MFG-E8 |
| Prostate Vesicles | CD9, CD63, CD81, MMP7, EpCAM |
| Prostate Cancer | let-7d, miR-148a, miR-195, miR-25, miR-26b, miR-329, miR-376c, miR-574-3p, miR-888, miR-9, miR1204, miR-16-2*, miR-497, miR-588, miR-614, miR-765, miR92b*, miR-938, let-7f-2*, miR-300, miR-523, miR-525-5p, miR-1182, miR-1244, miR-520d-3p, miR-379, let-7b, miR-125a-3p, miR-1296, miR-134, miR-149, miR-150, miR-187, miR-32, miR-324-3p, miR-324-5p, miR-342-3p, miR-378, miR-378*, miR-384, miR-451, miR-455-3p, miR-485-3p, miR-487a, miR-490-3p, miR-502-5p, miR-548a-5p, miR-550, miR-562, miR-593, miR-593*, miR-595, miR-602, miR-603, miR-654-5p, miR-877*, miR-886-5p, miR-125a-5p, miR-140-3p, miR-192, miR-196a, miR-2110, miR-212, miR-222, miR-224*, miR-30b*, miR-499-3p, miR-505* |
| Prostate Cancer | STAT3, EZH2, p53, MACC1, SPDEF, RUNX2, YB-1, AURKA, AURKB |
| Prostate Cancer (Ensembl ENSG identifiers) | E.001036, E.001497, E.001561, E.002330, E.003402, E.003756, E.004838, E.005471, E.005882, E.005893, E.006210, E.006453, E.006625, E.006695, E.006756, E.007264, E.007952, E.008118, E.008196, E.009694, E.009830, E.010244, E.010256, E.010278, E.010539, E.010810, E.011052, E.011114, E.011143, E.011304, E.011451, E.012061, E.012779, E.014216, E.014257, E.015133, E.015171, E.015479, E.015676, E.016402, E.018189, E.018699, E.020922, E.022976, E.023909, E.026508, E.026559, E.029363, E.029725, E.030582, E.033030, E.035141, E.036257, E.036448, E.038002, E.039068, E.039560, E.041353, E.044115, E.047410, E.047597, E.048544, E.048828, E.049239, |

TABLE 4-continued

Illustrative Biomarkers

| Illustrative Class | Biomarkers |
|---|---|
| | E.049246, E.049883, E.051596, E.051620, E.052795, E.053108, E.054118, E.054938, E.056097, E.057252, E.057608, E.058729, E.059122, E.059378, E.059691, E.060339, E.060688, E.061794, E.061918, E.062485, E.063241, E.063244, E.064201, E.064489, E.064655, E.064886, E.065054, E.065057, E.065308, E.065427, E.065457, E.065485, E.065526, E.065548, E.065978, E.066455, E.066557, E.067248, E.067369, E.067704, E.068724, E.068885, E.069535, E.069712, E.069849, E.069869, E.069956, E.070501, E.070785, E.070814, E.071246, E.071626, E.071859, E.072042, E.072071, E.072110, E.072506, E.073050, E.073350, E.073584, E.073756, E.074047, E.074071, E.074964, E.075131, E.075239, E.075624, E.075651, E.075711, E.075856, E.075886, E.076043, E.076248, E.076554, E.076864, E.077097, E.077147, E.077312, E.077514, E.077522, E.078269, E.078295, E.078808, E.078902, E.079246, E.079313, E.079785, E.080572, E.080823, E.081087, E.081138, E.081181, E.081721, E.081842, E.082212, E.082258, E.082556, E.083093, E.083720, E.084234, E.084463, E.085224, E.085733, E.086062, E.086205, E.086717, E.087087, E.087301, E.088888, E.088899, E.088930, E.088992, E.089048, E.089127, E.089154, E.089177, E.089248, E.089280, E.089902, E.090013, E.090060, E.090565, E.090612, E.090615, E.090674, E.090861, E.090889, E.091140, E.091483, E.091542, E.091732, E.092020, E.092199, E.092421, E.092621, E.092820, E.092871, E.092978, E.093010, E.094755, E.095139, E.095380, E.095485, E.095627, E.096060, E.096384, E.099331, E.099715, E.099783, E.099785, E.099800, E.099821, E.099899, E.099917, E.099956, E.100023, E.100056, E.100065, E.100084, E.100142, E.100191, E.100216, E.100242, E.100271, E.100284, E.100299, E.100311, E.100348, E.100359, E.100393, E.100399, E.100401, E.100412, E.100442, E.100575, E.100577, E.100583, E.100601, E.100603, E.100612, E.100632, E.100714, E.100739, E.100796, E.100802, E.100815, E.100823, E.100836, E.100883, E.101057, E.101126, E.101152, E.101222, E.101246, E.101265, E.101365, E.101439, E.101557, E.101639, E.101654, E.101811, E.101812, E.101901, E.102030, E.102054, E.102103, E.102158, E.102174, E.102241, E.102290, E.102316, E.102362, E.102384, E.102710, E.102780, E.102904, E.103035, E.103067, E.103175, E.103194, E.103449, E.103479, E.103591, E.103599, E.103855, E.103978, E.104064, E.104067, E.104131, E.104164, E.104177, E.104228, E.104331, E.104365, E.104419, E.104442, E.104611, E.104626, E.104723, E.104760, E.104805, E.104812, E.104823, E.104824, E.105127, E.105220, E.105221, E.105281, E.105379, E.105402, E.105404, E.105409, E.105419, E.105428, E.105486, E.105514, E.105518, E.105618, E.105705, E.105723, E.105939, E.105948, E.106049, E.106078, E.106128, E.106153, E.106346, E.106392, E.106554, E.106565, E.106603, E.106633, E.107104, E.107164, E.107404, E.107485, E.107551, E.107581, E.107623, E.107798, E.107816, E.107833, E.107890, E.107897, E.107968, E.108296, E.108312, E.108375, E.108387, E.108405, E.108417, E.108465, E.108561, E.108582, E.108639, E.108641, E.108848, E.108883, E.108953, E.109062, E.109184, E.109572, E.109625, E.109758, E.109790, E.109814, E.109846, E.109956, E.110063, E.110066, E.110104, E.110107, E.110321, E.110328, E.110921, E.110955, E.111057, E.111218, E.111261, E.111335, E.111540, E.111605, E.111647, E.111785, E.111790, E.111801, E.111907, E.112039, E.112081, E.112096, E.112110, E.112144, E.112232, E.112234, E.112473, E.112578, E.112584, E.112715, E.112941, E.113013, E.113163, E.113282, E.113368, E.113441, E.113448, E.113522, E.113580, E.113645, E.113719, E.113739, E.113790, E.114054, E.114127, E.114302, E.114331, E.114388, E.114491, E.114861, E.114867, E.115053, E.115221, E.115234, E.115239, E.115241, E.115257, E.115339, E.115540, E.115541, E.115561, E.115604, E.115648, E.115738, E.115758, E.116044, E.116096, E.116127, E.116254, E.116288, E.116455, E.116478, E.116604, E.116649, E.116726, E.116754, E.116833, E.117298, E.117308, E.117335, E.117362, E.117411, E.117425, E.117448, E.117480, E.117592, E.117593, E.117614, E.117676, E.117713, E.117748, E.117751, E.117877, E.118181, E.118197, E.118260, E.118292, E.118513, E.118523, E.118640, E.118898, E.119121, E.119138, E.119318, E.119321, E.119335, E.119383, E.119421, E.119636, E.119681, E.119711, E.119820, E.119888, E.119906, E.120159, E.120328, E.120337, E.120370, E.120656, E.120733, E.120837, E.120868, E.120915, E.120948, E.121022, E.121057, E.121068, E.121104, E.121390, E.121671, E.121690, E.121749, E.121774, E.121879, E.121892, E.121903, E.121940, E.121957, E.122025, E.122033, E.122126, E.122507, E.122566, E.122705, E.122733, E.122870, E.122884, E.122952, E.123066, E.123080, E.123143, E.123154, E.123178, E.123416, E.123427, E.123595, E.123901, E.123908, E.123983, E.123992, E.124143, E.124164, E.124181, E.124193, E.124216, E.124232, E.124529, E.124562, E.124570, E.124693, E.124749, E.124767, E.124788, E.124795, E.124831, E.124942, E.125246, E.125257, E.125304, E.125352, E.125375, E.125445, E.125492, E.125676, E.125753, E.125798, E.125844, E.125868, E.125901, E.125944, E.125995, E.126062, E.126267, E.126653, E.126773, E.126777, E.126814, E.126858, E.126883, E.126934, E.126945, E.126952, E.127022, E.127328, E.127329, E.127399, E.127415, E.127554, E.127616, E.127720, E.127824, E.127884, E.127914, E.127946, E.127948, E.128050, E.128311, E.128342, E.128609, E.128626, E.128683, E.128708, E.128881, E.129315, E.129351, E.129355, E.129514, E.129636, E.129657, E.129757, E.129810, E.129990, E.130175, E.130177, E.130193, E.130255, E.130299, E.130305, E.130338, E.130340, E.130402, E.130413, E.130612, E.130713, E.130764, E.130770, E.130810, E.130826, E.130935, E.131351, E.131467, E.131473, E.131771, E.131773, E.132002, E.132275, E.132323, E.132382, E.132475, E.132481, E.132589, E.132646, E.132716, E.132881, E.133313, E.133315, E.133687, E.133835, E.133863, E.133874, E.133961, E.134077, E.134138, E.134207, E.134248, E.134308, E.134444, E.134452, E.134548, E.134684, E.134759, E.134809, E.134851, E.134955, E.135052, E.135297, E.135298, E.135387, E.135390, E.135476, E.135486, E.135525, E.135597, E.135679, E.135740, E.135829, E.135842, E.135870, E.135900, E.135914, |

TABLE 4-continued

Illustrative Biomarkers

| Illustrative Class | Biomarkers |
|---|---|
| | E.135926, E.135940, E.135999, E.136044, E.136068, E.136152, E.136169, E.136280, E.136371, E.136383, E.136450, E.136521, E.136527, E.136574, E.136710, E.136750, E.136807, E.136874, E.136875, E.136930, E.136933, E.136935, E.137055, E.137124, E.137312, E.137409, E.137497, E.137513, E.137558, E.137601, E.137727, E.137776, E.137806, E.137814, E.137815, E.137948, E.137955, E.138028, E.138031, E.138041, E.138050, E.138061, E.138069, E.138073, E.138095, E.138160, E.138294, E.138347, E.138363, E.138385, E.138587, E.138594, E.138621, E.138674, E.138756, E.138757, E.138760, E.138772, E.138796, E.139211, E.139405, E.139428, E.139517, E.139613, E.139626, E.139684, E.139697, E.139874, E.140263, E.140265, E.140326, E.140350, E.140374, E.140382, E.140451, E.140481, E.140497, E.140632, E.140678, E.140694, E.140743, E.140932, E.141002, E.141012, E.141258, E.141378, E.141425, E.141429, E.141522, E.141543, E.141639, E.141744, E.141873, E.141994, E.142025, E.142208, E.142515, E.142606, E.142698, E.142765, E.142864, E.142875, E.143013, E.143294, E.143321, E.143353, E.143374, E.143375, E.143390, E.143578, E.143614, E.143621, E.143633, E.143771, E.143797, E.143816, E.143889, E.143924, E.143933, E.143947, E.144136, E.144224, E.144306, E.144381, E.144410, E.144485, E.144566, E.144671, E.144741, E.144935, E.145020, E.145632, E.145741, E.145833, E.145888, E.145907, E.145908, E.145919, E.145990, E.146067, E.146070, E.146281, E.146433, E.146457, E.146535, E.146701, E.146856, E.146966, E.147044, E.147127, E.147130, E.147133, E.147140, E.147231, E.147257, E.147403, E.147475, E.147548, E.147697, E.147724, E.148158, E.148396, E.148488, E.148672, E.148737, E.148835, E.149182, E.149218, E.149311, E.149480, E.149548, E.149646, E.150051, E.150593, E.150961, E.150991, E.151092, E.151093, E.151247, E.151304, E.151491, E.151690, E.151715, E.151726, E.151779, E.151806, E.152086, E.152207, E.152234, E.152291, E.152359, E.152377, E.152409, E.152422, E.152582, E.152763, E.152818, E.152942, E.153113, E.153140, E.153391, E.153904, E.153936, E.154099, E.154127, E.154380, E.154639, E.154723, E.154781, E.154832, E.154864, E.154889, E.154957, E.155368, E.155380, E.155508, E.155660, E.155714, E.155959, E.155980, E.156006, E.156194, E.156282, E.156304, E.156467, E.156515, E.156603, E.156650, E.156735, E.156976, E.157064, E.157103, E.157502, E.157510, E.157538, E.157551, E.157637, E.157764, E.157827, E.157992, E.158042, E.158290, E.158321, E.158485, E.158545, E.158604, E.158669, E.158715, E.158747, E.158813, E.158863, E.158901, E.158941, E.158987, E.159147, E.159184, E.159348, E.159363, E.159387, E.159423, E.159658, E.159692, E.159761, E.159921, E.160049, E.160226, E.160285, E.160294, E.160633, E.160685, E.160691, E.160789, E.160862, E.160867, E.160948, E.160972, E.161202, E.161267, E.161649, E.161692, E.161714, E.161813, E.161939, E.162069, E.162298, E.162385, E.162437, E.162490, E.162613, E.162641, E.162694, E.162910, E.162975, E.163041, E.163064, E.163110, E.163257, E.163468, E.163492, E.163530, E.163576, E.163629, E.163644, E.163749, E.163755, E.163781, E.163825, E.163913, E.163923, E.163930, E.163932, E.164045, E.164051, E.164053, E.164163, E.164244, E.164270, E.164300, E.164309, E.164442, E.164488, E.164520, E.164597, E.164749, E.164754, E.164828, E.164916, E.164919, E.164924, E.165084, E.165119, E.165138, E.165215, E.165259, E.165264, E.165280, E.165359, E.165410, E.165496, E.165637, E.165646, E.165661, E.165688, E.165695, E.165699, E.165792, E.165807, E.165813, E.165898, E.165923, E.165934, E.166263, E.166266, E.166329, E.166337, E.166341, E.166484, E.166526, E.166596, E.166598, E.166710, E.166747, E.166833, E.166860, E.166946, E.166971, E.167004, E.167085, E.167110, E.167113, E.167258, E.167513, E.167552, E.167553, E.167604, E.167635, E.167642, E.167658, E.167699, E.167744, E.167751, E.167766, E.167772, E.167799, E.167815, E.167969, E.167978, E.167987, E.167996, E.168014, E.168036, E.168066, E.168071, E.168148, E.168298, E.168393, E.168575, E.168653, E.168746, E.168763, E.168769, E.168803, E.168916, E.169087, E.169093, E.169122, E.169189, E.169213, E.169242, E.169410, E.169418, E.169562, E.169592, E.169612, E.169710, E.169763, E.169789, E.169807, E.169826, E.169957, E.170017, E.170027, E.170037, E.170088, E.170144, E.170275, E.170310, E.170315, E.170348, E.170374, E.170381, E.170396, E.170421, E.170430, E.170445, E.170549, E.170632, E.170703, E.170743, E.170837, E.170854, E.170906, E.170927, E.170954, E.170959, E.171121, E.171155, E.171180, E.171202, E.171262, E.171302, E.171345, E.171428, E.171488, E.171490, E.171492, E.171540, E.171643, E.171680, E.171723, E.171793, E.171861, E.171953, E.172115, E.172283, E.172345, E.172346, E.172466, E.172590, E.172594, E.172653, E.172717, E.172725, E.172733, E.172831, E.172867, E.172893, E.172939, E.173039, E.173230, E.173366, E.173473, E.173540, E.173585, E.173599, E.173714, E.173726, E.173805, E.173809, E.173826, E.173889, E.173898, E.173905, E.174021, E.174100, E.174332, E.174842, E.174996, E.175063, E.175110, E.175166, E.175175, E.175182, E.175198, E.175203, E.175216, E.175220, E.175334, E.175416, E.175602, E.175866, E.175946, E.176102, E.176105, E.176155, E.176171, E.176371, E.176515, E.176900, E.176971, E.176978, E.176994, E.177156, E.177239, E.177354, E.177409, E.177425, E.177459, E.177542, E.177548, E.177565, E.177595, E.177628, E.177674, E.177679, E.177694, E.177697, E.177731, E.177752, E.177951, E.178026, E.178078, E.178104, E.178163, E.178175, E.178187, E.178234, E.178381, E.178473, E.178741, E.178828, E.178950, E.179091, E.179115, E.179119, E.179348, E.179388, E.179776, E.179796, E.179869, E.179912, E.179981, E.180035, E.180198, E.180287, E.180318, E.180667, E.180869, E.180979, E.180998, E.181072, E.181163, E.181222, E.181234, E.181513, E.181523, E.181610, E.181773, E.181873, E.181885, E.181924, E.182013, E.182054, E.182217, E.182271, E.182318, E.182319, E.182512, E.182732, E.182795, E.182872, E.182890, E.182944, E.183048, E.183092, E.183098, E.183128, E.183207, E.183292, E.183431, E.183520, E.183684, E.183723, E.183785, E.183831, E.183856, E.184007, E.184047, |

TABLE 4-continued

Illustrative Biomarkers

| Illustrative Class | Biomarkers |
|---|---|
| | E.184113, E.184156, E.184254, E.184363, E.184378, E.184470, E.184481, E.184508, E.184634, E.184661, E.184697, E.184708, E.184735, E.184840, E.184916, E.185043, E.185049, E.185122, E.185219, E.185359, E.185499, E.185554, E.185591, E.185619, E.185736, E.185860, E.185896, E.185945, E.185972, E.186198, E.186205, E.186376, E.186472, E.186575, E.186591, E.186660, E.186814, E.186834, E.186868, E.186889, E.187097, E.187323, E.187492, E.187634, E.187764, E.187792, E.187823, E.187837, E.187840, E.188021, E.188171, E.188186, E.188739, E.188771, E.188846, E.189060, E.189091, E.189143, E.189144, E.189221, E.189283, E.196236, E.196419, E.196436, E.196497, E.196504, E.196526, E.196591, E.196700, E.196743, E.196796, E.196812, E.196872, E.196975, E.196993, E.197081, E.197157, E.197217, E.197223, E.197299, E.197323, E.197353, E.197451, E.197479, E.197746, E.197779, E.197813, E.197837, E.197857, E.197872, E.197969, E.197976, E.198001, E.198033, E.198040, E.198087, E.198131, E.198156, E.198168, E.198205, E.198216, E.198231, E.198265, E.198366, E.198431, E.198455, E.198563, E.198586, E.198589, E.198712, E.198721, E.198732, E.198783, E.198793, E.198804, E.198807, E.198824, E.198841, E.198951, E.203301, E.203795, E.203813, E.203837, E.203879, E.203908, E.204231, E.204316, E.204389, E.204406, E.204560, E.204574 |
| Prostate Markers (Ensembl ENSG identifiers) | E.005893 (LAMP2), E.006756 (ARSD), E.010539 (ZNF200), E.014257 (ACPP), E.015133 (CCDC88C), E.018699 (TTC27), E.044115 (CTNNA1), E.048828 (FAM120A), E.051620 (HEBP2), E.056097 (ZFR), E.060339 (CCAR1), E.063241 (ISOC2), E.064489 (MEF2BNB-MEF2B), E.064886 (CHI3L2), E.066455 (GOLGA5), E.069535 (MAOB), E.072042 (RDH11), E.072071 (LPHN1), E.074047 (GLI2), E.076248 (UNG), E.076554 (TPD52), E.077147 (TM9SF3), E.077312 (SNRPA), E.081842 (PCDHA6), E.086717 (PPEF1), E.088888 (MAVS), E.088930 (XRN2), E.089902 (RCOR1), E.090612 (ZNF268), E.092199 (HNRNPC), E.095380 (NANS), E.099783 (HNRNPM), E.100191 (SLC5A4), E.100216 (TOMM22), E.100242 (SUN2), E.100284 (TOM1), E.100401 (RANGAP1), E.100412 (ACO2), E.100836 (PABPN1), E.102054 (RBBP7), E.102103 (PQBP1), E.103599 (IQCH), E.103978 (TMEM87A), E.104177 (MYEF2), E.104228 (TRIM35), E.105428 (ZNRF4), E.105518 (TMEM205), E.106603 (C7orf44; COA1), E.108405 (P2RX1), E.111057 (KRT18), E.111218 (PRMT8), E.112081 (SRSF3), E.112144 (ICK), E.113013 (HSPA9), E.113368 (LMNB1), E.115221 (ITGB6), E.116096 (SPR), E.116754 (SRSF11), E.118197 (DDX59), E.118898 (PPL), E.119121 (TRPM6), E.119711 (ALDH6A1), E.120656 (TAF12), E.121671 (CRY2), E.121774 (KHDRBS1), E.122126 (OCRL), E.122566 (HNRNPA2B1), E.123901 (GPR83), E.124562 (SNRPC), E.124788 (ATXN1), E.124795 (DEK), E.125246 (CLYBL), E.126883 (NUP214), E.127616 (SMARCA4), E.127884 (ECHS1), E.128050 (PAICS), E.129351 (ILF3), E.129757 (CDKN1C), E.130338 (TULP4), E.130612 (CYP2G1P), E.131351 (HAUS8), E.131467 (PSME3), E.133315 (MACROD1), E.134452 (FBXO18), E.134851 (TMEM165), E.135940 (COX5B), E.136169 (SETDB2), E.136807 (CDK9), E.137727 (ARHGAP20), E.138031 (ADCY3), E.138050 (THUMPD2), E.138069 (RAB1A), E.138594 (TMOD3), E.138760 (SCARB2), E.138796 (HADH), E.139613 (SMARCC2), E.139684 (ESD), E.140263 (SORD), E.140350 (ANP32A), E.140632 (GLYR1), E.142765 (SYTL1), E.143621 (ILF2), E.143933 (CALM2), E.144410 (CPO), E.147127 (RAB41), E.151304 (SRFBP1), E.151806 (GUF1), E.152207 (CYSLTR2), E.152234 (ATP5A1), E.152291 (TGOLN2), E.154723 (ATP5J), E.156467 (UQCRB), E.159387 (IRX6), E.159761 (C16orf86), E.161813 (LARP4), E.162613 (FUBP1), E.162694 (EXTL2), E.165264 (NDUFB6), E.167113 (COQ4), E.167513 (CDT1), E.167772 (ANGPTL4), E.167978 (SRRM2), E.168916 (ZNF608), E.169763 (PRYP3), E.169789 (PRY), E.169807 (PRY2), E.170017 (ALCAM), E.170144 (HNRNPA3), E.170310 (STX8), E.170954 (ZNF415), E.170959 (DCDC5), E.171302 (CANT1), E.171643 (S100Z), E.172283 (PRYP4), E.172590 (MRPL52), E.172867 (KRT2), E.173366 (TLR9), E.173599 (PC), E.177595 (PIDD), E.178473 (UCN3), E.179981 (TSHZ1), E.181163 (NPM1), E.182319 (Tyrosine-protein kinase SgK223), E.182795 (C1orf116), E.182944 (EWSR1), E.183092 (BEGAIN), E.183098 (GPC6), E.184254 (ALDH1A3), E.185619 (PCGF3), E.186889 (TMEM17), E.187837 (HIST1H1C), E.188771 (C11orf34), E.189060 (H1F0), E.196419 (XRCC6), E.196436 (NPIPL2), E.196504 (PRPF40A), E.196796, E.196993, E.197451 (HNRNPAB), E.197746 (PSAP), E.198131 (ZNF544), E.198156, E.198732 (SMOC1), E.198793 (MTOR), E.039068 (CDH1), E.173230 (GOLGB1), E.124193 (SRSF6), E.140497 (SCAMP2), E.168393 (DTYMK), E.184708 (EIF4ENIF1), E.124164 (VAPB), E.125753 (VASP), E.118260 (CREB1), E.135052 (GOLM1), E.010244 (ZNF207), E.010278 (CD9), E.047597 (XK), E.049246 (PER3), E.069849 (ATP1B3), E.072506 (HSD17B10), E.081138 (CDH7), E.099785 (MARCH2), E.104331 (IMPAD1), E.104812 (GYS1), E.120868 (APAF1), E.123908 (EIF2C2), E.125492 (BARHL1), E.127328 (RAB3IP), E.127329 (PTPRB), E.129514 (FOXA1), E.129657 (SEC14L1), E.129990 (SYT5), E.132881 (RSG1), E.136521 (NDUFB5), E.138347 (MYPN), E.141429 (GALNT1), E.144566 (RAB5A), E.151715 (TMEM45B), E.152582 (SPEF2), E.154957 (ZNF18), E.162385 (MAGOH), E.165410 (CFL2), E.168298 (HIST1H1E), E.169418 (NPR1), E.178187 (ZNF454), E.178741 (COX5A), E.179115 (FARSA), E.182732 (RGS6), E.183431 (SF3A3), E.185049 (WHSC2), E.196236 (XPNPEP3), E.197217 (ENTPD4), E.197813, E.203301, E.116833 (NR5A2), E.121057 (AKAP1), E.005471 (ABCB4), E.071859 (FAM50A), E.084234 (APLP2), E.101222 (SPEF1), E.103175 (WFDC1), E.103449 (SALL1), E.104805 (NUCB1), E.105514 (RAB3D), E.107816 (LZTS2), E.108375 (RNF43), E.109790 (KLHL5), E.112039 (FANCE), E.112715 (VEGFA), E.121690 (DEPDC7), E.125352 (RNF113A), E.134548 (C12orf39), E.136152 (COG3), E.143816 (WNT9A), E.147130 (ZMYM3), E.148396 (SEC16A), E.151092 (NGLY1), E.151779 (NBAS), E.155508 (CNOT8), E.163755 (HPS3), |

TABLE 4-continued

Illustrative Biomarkers

| Illustrative Class | Biomarkers |
|---|---|
| | E.166526 (ZNF3), E.172733 (PURG), E.176371 (ZSCAN2), E.177674 (AGTRAP), E.181773 (GPR3), E.183048 (SLC25A10; MRPL12 SLC25A10), E.186376 (ZNF75D), E.187323 (DCC), E.198712 (MT-CO2), E.203908 (C6orf221; KHDC3L), E.001497 (LAS1L), E.009694 (ODZ1), E.080572 (CXorf41; PIH1D3), E.083093 (PALB2), E.089048 (ESF1), E.100065 (CARD10), E.100739 (BDKRB1), E.102904 (TSNAXIP1), E.104824 (HNRNPL), E.107404 (DVL1), E.110066 (SUV420H1), E.120328 (PCDHB12), E.121903 (ZSCAN20), E.122025 (FLT3), E.136930 (PSMB7), E.142025 (DMRTC2), E.144136 (SLC20A1), E.146535 (GNA12), E.147140 (NONO), E.153391 (INO80C), E.164919 (COX6C), E.171540 (OTP), E.177951 (BET1L), E.179796 (LRRC3B), E.197479 (PCDHB11), E.198804 (MT-001), E.086205 (FOLH1), E.100632 (ERH), E.100796 (SMEK1), E.104760 (FGL1), E.114302 (PRKAR2A), E.130299 (GTPBP3), E.133961 (NUMB), E.144485 (HES6), E.167085 (PHB), E.167635 (ZNF146), E.177239 (MAN1B1), E.184481 (FOXO4), E.188171 (ZNF626), E.189221 (MAOA), E.157637 (SLC38A10), E.100883 (SRP54), E.105618 (PRPF31), E.119421 (NDUFA8), E.170837 (GPR27), E.168148 (HIST3H3), E.135525 (MAP7), E.174996 (KLC2), E.018189 (RUFY3), E.183520 (UTP11L), E.173905 (GOLIM4), E.165280 (VCP), E.022976 (ZNF839), E.059691 (PET112), E.063244 (U2AF2), E.075651 (PLD1), E.089177 (KIF16B), E.089280 (FUS), E.094755 (GABRP), E.096060 (FKBP5), E.100023 (PPIL2), E.100359 (SGSM3), E.100612 (DHRS7), E.104131 (EIF3J), E.104419 (NDRG1), E.105409 (ATP1A3), E.107623 (GDF10), E.111335 (OAS2), E.113522 (RAD50), E.115053 (NCL), E.120837 (NFYB), E.122733 (KIAA1045), E.123178 (SPRYD7), E.124181 (PLCG1), E.126858 (RHOT1), E.128609 (NDUFA5), E.128683 (GAD1), E.130255 (RPL36), E.133874 (RNF122), E.135387 (CAPRIN1), E.135999 (EPC2), E.136383 (ALPK3), E.139405 (C12orf52), E.141012 (GALNS), E.143924 (EML4), E.144671 (SLC22A14), E.145741 (BTF3), E.145907 (G3BP1), E.149311 (ATM), E.153113 (CAST), E.157538 (DSCR3), E.157992 (KRTCAP3), E.158901 (WFDC8), E.165259 (HDX), E.169410 (PTPN9), E.170421 (KRT8), E.171155 (C1GALT1C1), E.172831 (CES2), E.173726 (TOMM20), E.176515, E.177565 (TBL1XR1), E.177628 (GBA), E.179091 (CYC1), E.189091 (SF3B3), E.197299 (BLM), E.197872 (FAM49A), E.198205 (ZXDA), E.198455 (ZXDB), E.082212 (ME2), E.109956 (B3GAT1), E.169710 (FASN), E.011304 (PTBP1), E.057252 (SOAT1), E.059378 (PARP12), E.082258 (CCNT2), E.087301 (TXNDC16), E.100575 (TIMM9), E.101152 (DNAJC5), E.101812 (H2BFM), E.102384 (CENPI), E.108641 (B9D1), E.119138 (KLF9), E.119820 (YIPF4), E.125995 (ROMO1), E.132323 (ILKAP), E.134809 (TIMM10), E.134955 (SLC37A2), E.135476 (ESPL1), E.136527 (TRA2B), E.137776 (SLTM), E.139211 (AMIGO2), E.139428 (MMAB), E.139874 (SSTR1), E.143321 (HDGF), E.164244 (PRRC1), E.164270 (HTR4), E.165119 (HNRNPK), E.165637 (VDAC2), E.165661 (QSOX2), E.167258 (CDK12), E.167815 (PRDX2), E.168014 (C2CD3), E.168653 (NDUFS5), E.168769 (TET2), E.169242 (EFNA1), E.175334 (BANF1), E.175416 (CLTB), E.177156 (TALDO1), E.180035 (ZNF48), E.186591 (UBE2H), E.187097 (ENTPD5), E.188739 (RBM34), E.196497 (IP04), E.197323 (TRIM33), E.197857 (ZNF44), E.197976 (AKAP17A), E.064201 (TSPAN32), E.088992 (TESC), E.092421 (SEMA6A), E.100601 (ALKBH1), E.101557 (USP14), E.103035 (PSMD7), E.106128 (GHRHR), E.115541 (HSPE1), E.121390 (PSPC1), E.124216 (SNAI1), E.130713 (EXOSC2), E.132002 (DNAJB1), E.139697 (SBNO1), E.140481 (CCDC33), E.143013 (LMO4), E.145020 (AMT), E.145990 (GFOD1), E.146070 (PLA2G7), E.164924 (YWHAZ), E.165807 (PPP1R36), E.167751 (KLK2), E.169213 (RAB3B), E.170906 (NDUFA3), E.172725 (CORO1B), E.174332 (GLIS1), E.181924 (CHCHD8), E.183128 (CALHM3), E.204560 (DHX16), E.204574 (ABCF1), E.146701 (MDH2), E.198366 (HIST1H3A), E.081181 (ARG2), E.185896 (LAMP1), E.077514 (POLD3), E.099800 (TIMM13), E.100299 (ARSA), E.105419 (MEIS3), E.108417 (KRT37), E.113739 (STC2), E.125868 (DSTN), E.145908 (ZNF300), E.168575 (SLC20A2), E.182271 (TMIGD1), E.197223 (C1D), E.186834 (HEXIM1), E.001561 (ENPP4), E.011451 (WIZ), E.053108 (FSTL4), E.064655 (EYA2), E.065308 (TRAM2), E.075131 (TIPIN), E.081087 (OSTM1), E.092020 (PPP2R3C), E.096384 (HSP90AB1), E.100348 (TXN2), E.100577 (GSTZ1), E.100802 (C14orf93), E.101365 (IDH3B), E.101654 (RNMT), E.103067 (ESRP2), E.104064 (GABPB1), E.104823 (ECH1), E.106565 (TMEM176B), E.108561 (C1QBP), E.115257 (PCSK4), E.116127 (ALMS1), E.117411 (B4GALT2), E.119335 (SET), E.120337 (TNFSF18), E.122033 (MTIF3), E.122507 (BBS9), E.122870 (BICC1), E.130177 (CDC16), E.130193 (C8orf55; THEME), E.130413 (STK33), E.130770 (ATPIF1), E.133687 (TMTC1), E.136874 (STX17), E.137409 (MTCH1), E.139626 (ITGB7), E.141744 (PNMT), E.145888 (GLRA1), E.146067 (FAM193B), E.146433 (TMEM181), E.149480 (MTA2), E.152377 (SPOCK1), E.152763 (WDR78), E.156976 (EIF4A2), E.157827 (FMNL2), E.158485 (CD1B), E.158863 (FAM160B2), E.161202 (DVL3), E.161714 (PLCD3), E.163064 (EN1), E.163468 (CCT3), E.164309 (CMYA5), E.164916 (FOXK1), E.165215 (CLDN3), E.167658 (EEF2), E.170549 (IRX1), E.171680 (PLEKHG5), E.178234 (GALNT11), E.179869 (ABCA13), E.179912 (R3HDM2), E.180869 (C1orf180), E.180979 (LRRC57), E.182872 (RBM10), E.183207 (RUVBL2), E.184113 (CLDN5), E.185972 (CCIN), E.189144 (ZNF573), E.197353 (LYPD2), E.197779 (ZNF81), E.198807 (PAX9), E.100442 (FKBP3), E.111790 (FGFR1OP2), E.136044 (APPL2), E.061794 (MRPS35), E.065427 (KARS), E.068885 (IFT80), E.104164 (PLDN; BLOC1S6), E.105127 (AKAP8), E.123066 (MED13L), E.124831 (LRRFIP1), E.125304 (TM9SF2), E.126934 (MAP2K2), E.130305 (NSUN5), E.135298 (BAI3), E.135900 (MRPL44), E.136371 (MTHFS), E.136574 |

TABLE 4-continued

Illustrative Biomarkers

| Illustrative Class | Biomarkers |
|---|---|
| | (GATA4), E.140326 (CDAN1), E.141378 (PTRH2), E.141543 (EIF4A3), E.150961 (SEC24D), E.155368 (DBI), E.161649 (CD300LG), E.161692 (DBF4B), E.162437 (RAVER2), E.163257 (DCAF16), E.163576 (EFHB), E.163781 (TOPBP1), E.163913 (IFT122), E.164597 (COGS), E.165359 (DDX26B), E.165646 (SLC18A2), E.169592 (INO80E), E.169957 (ZNF768), E.171492 (LRRC8D), E.171793 (CTPS; CTPS1), E.171953 (ATPAF2), E.175182 (FAM131A), E.177354 (C10orf71), E.181610 (MRPS23), E.181873 (IBA57), E.187792 (ZNF70), E.187823 (ZCCHC16), E.196872 (C2orf55; KIAA1211L), E.198168 (SVIP), E.160633 (SAFB), E.177697 (CD151), E.181072 (CHRM2), E.012779 (ALOX5), E.065054 (SLC9A3R2), E.074071 (MRPS34), E.100815 (TRIP11), E.102030 (NAA10), E.106153 (CHCHD2), E.126814 (TRMT5), E.126952 (NXF5), E.136450 (SRSF1), E.136710 (CCDC115), E.137124 (ALDH1B1), E.143353 (LYPLAL1), E.162490 (C1orf187; DRAXIN), E.167799 (NUDT8), E.171490 (RSL1D1), E.173826 (KCNH6), E.173898 (SPTBN2), E.176900 (OR51T1), E.181513 (ACBD4), E.185554 (NXF2), E.185945 (NXF2B), E.108848 (LUC7L3), E.029363 (BCLAF1), E.038002 (AGA), E.108312 (UBTF), E.166341 (DCHS1), E.054118 (THRAP3), E.135679 (MDM2), E.166860 (ZBTB39), E.183684 (THOC4; ALYREF), E.004838 (ZMYND10), E.007264 (MATK), E.020922 (MRE11A), E.041353 (RAB27B), E.052795 (FNIP2), E.075711 (DLG1), E.087087 (SRRT), E.090060 (PAPOLA), E.095139 (ARCN1), E.099715 (PCDH11Y), E.100271 (TTLL1), E.101057 (MYBL2), E.101265 (RASSF2), E.101901 (ALG13), E.102290 (PCDH11X), E.103194 (USP10), E.106554 (CHCHD3), E.107833 (NPM3), E.110063 (DCPS), E.111540 (RAB5B), E.113448 (PDE4D), E.115339 (GALNT3), E.116254 (CHDS), E.117425 (PTCH2), E.117614 (SYF2), E.118181 (RPS25), E.118292 (C1orf54), E.119318 (RAD23B), E.121022 (COPS5), E.121104 (FAM117A), E.123427 (METTL21B), E.125676 (THOC2), E.132275 (RRP8), E.137513 (NARS2), E.138028 (CGREF1), E.139517 (LNX2), E.143614 (GATAD2B), E.143889 (HNRPLL), E.145833 (DDX46), E.147403 (RPL10), E.148158 (SNX30), E.151690 (MFSD6), E.153904 (DDAH1), E.154781 (C3orf19), E.156650 (KAT6B), E.158669 (AGPAT6), E.159363 (ATP13A2), E.163530 (DPPA2), E.164749 (HNF4G), E.165496 (RPL10L), E.165688 (PMPCA), E.165792 (METTL17), E.166598 (HSP90B1), E.168036 (CTNNB1), E.168746 (C20orf62), E.170381 (SEMA3E), E.171180 (OR2M4), E.171202 (TMEM126A), E.172594 (SMPDL3A), E.172653 (C17orf66), E.173540 (GMPPB), E.173585 (CCR9), E.173809 (TDRD12), E.175166 (PSMD2), E.177694 (NAALADL2), E.178026 (FAM211B; C22orf36), E.184363 (PKP3), E.187634 (SAMD11), E.203837 (PNLIPRP3), E.169122 (FAM110B), E.197969 (VPS13A), E.136068 (FLNB), E.075856 (SART3), E.081721 (DUSP12), E.102158 (MAGT1), E.102174 (PHEX), E.102316 (MAGED2), E.104723 (TUSC3), E.105939 (ZC3HAV1), E.108883 (EFTUD2), E.110328 (GALNTL4), E.111785 (RIC8B), E.113163 (COL4A3BP), E.115604 (IL18R1), E.117362 (APH1A), E.117480 (FAAH), E.124767 (GLO1), E.126267 (COX6B1), E.130175 (PRKCSH), E.135926 (TMBIM1), E.138674 (SEC31A), E.140451 (PIF1), E.143797 (MBOAT2), E.149646 (C20orf152), E.157064 (NMNAT2), E.160294 (MCM3AP), E.165084 (C8orf34), E.166946 (CCNDBP1), E.170348 (TMED10), E.170703 (TTLL6), E.175198 (PCCA), E.180287 (PLDS), E.183292 (MIR5096), E.187492 (CDHR4), E.188846 (RPL14), E.015479 (MATR3), E.100823 (APEX1), E.090615 (GOLGA3), E.086062 (B4GALT1), E.138385 (SSB), E.140265 (ZSCAN29), E.140932 (CMTM2), E.167969 (ECI1), E.135486 (HNRNPA1), E.137497 (NUMA1), E.181523 (SGSH), E.099956 (SMARCB1), E.049883 (PTCD2), E.082556 (OPRK1), E.090674 (MCOLN1), E.107164 (FUBP3), E.108582 (CPD), E.109758 (HGFAC), E.111605 (CPSF6), E.115239 (ASB3), E.121892 (PDSSA), E.125844 (RRBP1), E.130826 (DKC1), E.132481 (TRIM47), E.135390 (ATP5G2), E.136875 (PRPF4), E.138621 (PPCDC), E.145632 (PLK2), E.150051 (MKX), E.153140 (CETN3), E.154127 (UBASH3B), E.156194 (PPEF2), E.163825 (RTP3), E.164053 (ATRIP), E.164442 (CITED2), E.168066 (SF1), E.170430 (MGMT), E.175602 (CCDC85B), E.177752 (YIPF7), E.182512 (GLRXS), E.188186 (C7orf59), E.198721 (ECI2), E.204389 (HSPA1A), E.010256 (UQCRC1), E.076043 (REXO2), E.102362 (SYTL4), E.161939 (C17orf49), E.173039 (RELA), E.014216 (CAPN1), E.054938 (CHRDL2), E.065526 (SPEN), E.070501 (POLB), E.078808 (SDF4), E.083720 (OXCT1), E.100084 (HIRA), E.101246 (ARFRP1), E.102241 (HTATSF1), E.103591 (AAGAB), E.104626 (ERI1), E.105221 (AKT2), E.105402 (NAPA), E.105705 (SUGP1), E.106346 (USP42), E.108639 (SYNGR2), E.110107 (PRPF19), E.112473 (SLC39A7), E.113282 (CLINT1), E.115234 (SNX17), E.115561 (CHMP3), E.119906 (FAM178A), E.120733 (KDM3B), E.125375 (ATP5S), E.125798 (FOXA2), E.127415 (IDUA), E.129810 (SGOL1), E.132382 (MYBBP1A), E.133313 (CNDP2), E.134077 (THUMPD3), E.134248 (HBXIP), E.135597 (REPS1), E.137814 (HAUS2), E.138041 (SMEK2), E.140382 (HMG20A), E.143578 (CREB3L4), E.144224 (UBXN4), E.144306 (SCRN3), E.144741 (SLC25A26), E.145919 (BOD1), E.146281 (PM20D2), E.152359 (POC5), E.152409 (JMY), E.154889 (MPPE1), E.157551 (KCNJ15), E.157764 (BRAF), E.158987 (RAPGEF6), E.162069 (CCDC64B), E.162910 (MRPL55), E.163749 (CCDC158), E.164045 (CDC25A), E.164300 (SERINC5), E.165898 (ISCA2), E.167987 (VPS37C), E.168763 (CNNM3), E.170374 (SP7), E.171488 (LRRC8C), E.178381 (ZFAND2A), E.180998 (GPR137C), E.182318 (ZSCAN22), E.198040 (ZNF84), E.198216 (CACNA1E), E.198265 (HELZ), E.198586 (TLK1), E.203795 (FAM24A), E.204231 (RXRB), E.123992 (DNPEP), E.184634 (MED12), E.181885 (CLDN7), E.186660 (ZFP91), E.126777 (KTN1), E.080823 (MOK), E.101811 (CSTF2), E.124570 (SERPINB6), E.148835 (TAF5), E.158715 (SLC45A3), E.110955 (ATP5B), E.127022 (CANX), E.142208 (AKT1), |

TABLE 4-continued

Illustrative Biomarkers

| Illustrative Class | Biomarkers |
|---|---|
| | E.128881 (TTBK2), E.147231 (CXorf57), E.006210 (CX3CL1), E.009830 (POMT2), E.011114 (BTBD7), E.065057 (NTHL1), E.068724 (TTC7A), E.073584 (SMARCE1), E.079785 (DDX1), E.084463 (WBP11), E.091140 (DLD), E.099821 (POLRMT), E.101126 (ADNP), E.104442 (ARMC1), E.105486 (LIG1), E.110921 (MVK), E.113441 (LNPEP), E.115758 (ODC1), E.116726 (PRAMEF12), E.119681 (LTBP2), E.136933 (RABEPK), E.137815 (RTF1), E.138095 (LRPPRC), E.138294 (MSMB), E.141873 (SLC39A3), E.142698 (C1orf94), E.143390 (RFX5), E.148488 (ST8SIA6), E.148737 (TCF7L2), E.151491 (EPS8), E.152422 (XRCC4), E.154832 (CXXC1), E.158321 (AUTS2), E.159147 (DONSON), E.160285 (LSS), E.160862 (AZGP1), E.160948 (VPS28), E.160972 (PPP1R16A), E.165934 (CPSF2), E.167604 (NFKBID), E.167766 (ZNF83), E.168803 (ADAL), E.169612 (FAM103A1), E.171262 (FAM98B), E.172893 (DHCR7), E.173889 (PHC3), E.176971 (FIBIN), E.177548 (RABEP2), E.179119 (SPTY2D1), E.184378 (ACTRT3), E.184508 (HDDC3), E.185043 (CIB1), E.186814 (ZSCAN30), E.186868 (MAPT), E.196812 (ZSCAN16), E.198563 (DDX39B), E.124529 (HIST1H4B), E.141002 (TCF25), E.174100 (MRPL45), E.109814 (UGDH), E.138756 (BMP2K), E.065457 (ADAT1), E.105948 (TTC26), E.109184 (DCUN1D4), E.125257 (ABCC4), E.126062 (TMEM115), E.142515 (KLK3), E.144381 (HSPD1), E.166710 (B2M), E.198824 (CHAMP1), E.078902 (TOLLIP), E.099331 (MYO9B), E.102710 (FAM48A), E.107485 (GATA3), E.120948 (TARDBP), E.187764 (SEMA4D), E.103855 (CD276), E.117751 (PPP1R8), E.173714 (WFIKKN2), E.172115 (CYCS), E.005882 (PDK2), E.007952 (NOX1), |
| | E.008118 (CAMK1G), E.012061 (ERCC1), E.015171 (ZMYND11), E.036257 (CUL3), E.057608 (GDI2), E.058729 (RIOK2), E.071246 (VASH1), E.073050 (XRCC1), E.073350 (LLGL2), E.079246 (XRCC5), E.085733 (CTTN), E.091542 (ALKBH5), E.091732 (ZC3HC1), E.092621 (PHGDH), E.099899 (TRMT2A), E.099917 (MED15), E.101439 (CST3), E.103479 (RBL2), E.104611 (SH2D4A), E.105281 (SLC1A5), E.106392 (C1GALT1), E.107104 (KANK1), E.107798 (LIPA), E.108296 (CWC25), E.109572 (CLCN3), E.112110 (MRPL18), E.113790 (EHHADH), E.115648 (MLPH), E.117308 (GALE), E.117335 (CD46), E.118513 (MYB), E.118640 (VAMP8), E.119321 (FKBP15), E.122705 (CLTA), E.123983 (ACSL3), E.124232 (RBPJL), E.125901 (MRPS26), E.127399 (LRRC61), E.127554 (GFER), E.128708 (HAT1), E.129355 (CDKN2D), E.130340 (SNX9), E.130935 (NOL11), E.131771 (PPP1R1B), E.133863 (TEX15), E.134207 (SYT6), E.136935 (GOLGA1), E.141425 (RPRD1A), E.143374 (TARS2), E.143771 (CNIH4), E.146966 (DENND2A), E.148672 (GLUD1), E.150593 (PDCD4), E.153936 (HS2ST1), E.154099 (DNAAF1), E.156006 (NAT2), E.156282 (CLDN17), E.158545 (ZC3H18), E.158604 (TMED4), E.158813 (EDA), E.159184 (HOXB13), E.161267 (BDH1), E.163492 (CCDC141), E.163629 (PTPN13), E.164163 (ABCE1), E.164520 (RAET1E), E.165138 (ANKS6), E.165923 (AGBL2), E.166484 (MAPK7), E.166747 (AP1G1), E.166971 (AKTIP), E.167744 (NTF4), E.168071 (CCDC88B), E.169087 (HSPBAP1), E.170396 (ZNF804A), E.170445 (BARS), E.170632 (ARMC10), E.170743 (SYT9), E.171428 (NAT1), E.172346 (CSDC2), E.173805 (HAP1), E.175175 (PPM1E), E.175203 (DCTN2), E.177542 (SLC25A22), E.177679 (SRRM3), E.178828 (RNF186), E.182013 (PNMAL1), E.182054 (IDH2), E.182890 (GLUD2), E.184156 (KCNQ3), E.184697 (CLDN6), E.184735 (DDX53), E.184840 (TMED9), E.185219 (ZNF445), E.186198 (SLC51B), E.186205 (MOSC1; MARC1), E.189143 (CLDN4), E.196700 (ZNF512B), E.196743 (GM2A), E.198087 (CD2AP), E.198951 (NAGA), E.204406 (MBDS), E.002330 (BAD), E.105404 (RABAC1), E.114127 (XRN1), E.117713 (ARID1A), E.123143 (PKN1), E.130764 (LRRC47), E.131773 (KHDRBS3), E.137806 (NDUFAF1), E.142864 (SERBP1), E.158747 (NBL1), E.175063 (UBE2C), E.178104 (PDE4DIP), E.186472 (PCLO), E.069956 (MAPK6), |
| | E.112941 (PAPD7), E.116604 (MEF2D), E.142875 (PRKACB), E.147133 (TAF1), E.157510 (AFAP1L1), E.006625 (GGCT), E.155980 (KIFSA), E.134444 (KIAA1468), E.107968 (MAP3K8), E.117592 (PRDX6), E.123154 (WDR83), E.135297 (MTO1), E.135829 (DHX9), E.149548 (CCDC15), E.152086 (TUBA3E), E.167553 (TUBA1C), E.169826 (CSGALNACT2), E.171121 (KCNMB3), E.198033 (TUBA3C), E.147724 (FAM135B), E.170854 (MINA), E.006695 (COX10), E.067369 (TP53BP1), E.089248 (ERP29), E.112096 (SOD2), E.138073 (PREB), E.146856 (AGBL3), E.159423 (ALDH4A1), |
| | E.171345 (KRT19), E.172345 (STARD5), E.111647 (UHRF1BP1L), E.117877 (CD3EAP), E.155714 (PDZD9), E.156603 (MED19), E.075886 (TUBA3D), E.167699 (GLOD4), E.121749 (TBC1D15), E.090861 (AARS), E.093010 (COMT), E.117676 (RPS6KA1), E.157502 (MUM1L1), E.159921 (GNE), E.169562 (GJB1), E.179776 (CDH5), E.071626 (DAZAP1), E.085224 (ATRX), E.116478 (HDAC1), E.117298 (ECE1), E.176171 (BNIP3), E.177425 (PAWR), E.179348 (GATA2), E.187840 (EIF4EBP1), E.033030 (ZCCHC8), E.049239 (H6PD), E.060688 (SNRNP40), E.075239 (ACAT1), E.095627 (TDRD1), E.109625 (CPZ), E.113719 (ERGIC1), E.126773 (C14orf135; PCNXL4), E.149218 (ENDOD1), E.162975 (KCNF1), E.183785 (TUBAE), E.198589 (LRBA), E.105379 (ETFB), |
| | E.011052 (NME2), E.011143 (MKS1), E.048544 (MRPS10), E.062485 (CS), E.114054 (PCCB), E.138587 (MNS1), E.155959 (VBP1), E.181222 (POLR2A), E.183723 (CMTM4), E.184661 (CDCA2), E.204316 (MRPL38), E.140694 (PARN), E.035141 (FAM136A), E.095485 (CWF19L1), E.115540 (MOB4), E.123595 (RAB9A), E.140678 (ITGAX), E.141258 (SGSM2), E.158941 (KIAA1967), E.169189 (NSMCE1), E.198431 (TXNRD1), E.016402 (IL20RA), E.112234 (FBXL4), E.125445 (MRPS7), E.128342 (LIF), E.164051 (CCDC51), E.175866 (BAIAP2), E.102780 (DGKH), E.203813 (HIST1H3H), E.198231 (DDX42), E.030582 (GRN), E.106049 (HIBADH), E.130810 (PPAN), E.132475 (H3F3B), |

TABLE 4-continued

Illustrative Biomarkers

| Illustrative Class | Biomarkers |
|---|---|
| | E.158290 (CUL4B), E.166266 (CUL5), E.026559 (KCNG1), E.059122 (FLYWCH1), E.107897 (ACBD5), E.121068 (TBX2), E.125944 (HNRNPR), E.134308 (YWHAQ), E.137558 (PI15), E.137601 (NEK1), E.147548 (WHSC1L1), E.149182 (ARFGAP2), E.159658 (KIAA0494), E.165699 (TSC1), E.170927 (PKHD1), E.186575 (NF2), E.188021 (UBQLN2), E.167552 (TUBA1A), E.003756 (RBM5), E.134138 (MEIS2), E.008196 (TFAP2B), E.079313 (REXO1), E.089127 (OAS1), E.106078 (COBL), E.113645 (WWC1), E.116288 (PARK7), E.121940 (CLCC1), E.136280 (CCM2), E.141639 (MAPK4), E.147475 (ERLIN2), E.155660 (PDIA4), E.162298 (SYVN1), E.176978 (DPP7), E.176994 (SMCR8), E.178175 (ZNF366), E.196591 (HDAC2), E.127824 (TUBA4A), E.163932 (PRKCD), E.143375 (CGN), E.076864 (RAP1GAP), E.138772 (ANXA3), E.163041 (H3F3A), E.165813 (C10orf118), E.166337 (TAF10), E.178078 (STAP2), E.184007 (PTP4A2), E.167004 (PDIA3), E.039560 (RAI14), E.119636 (C14orf45), E.140374 (ETFA), E.143633 (C1orf131), E.144935 (TRPC1), E.156735 (BAG4), E.159348 (CYB5R1), E.170275 (CRTAP), E.172717 (FAM71D), E.172939 (OXSR1), E.176105 (YES1), E.078295 (ADCY2), E.119888 (EPCAM), E.141522 (ARHGDIA), E.184047 (DIABLO), E.109062 (SLC9A3R1), E.170037 (CNTROB), E.066557 (LRRC40), E.074964 (ARHGEF10L), E.078269 (SYNJ2), E.090013 (BLVRB), E.100142 (POLR2F), E.100399 (CHADL), E.104365 (IKBKB), E.111261 (MANSC1), E.111907 (TPD52L1), E.112578 (BYSL), E.121957 (GPSM2), E.122884 (P4HA1), E.124693 (HIST1H3B), E.126653 (NSRP1), E.130402 (ACTN4), E.138757 (G3BP2), E.150991 (UBC), E.164828 (SUN1), E.175216 (CKAP5), E.176155 (CCDC57), E.177459 (C8orf47), E.183856 (IQGAP3), E.185122 (HSF1), E.122952 (ZWINT), E.151093 (OXSM), E.067704 (IARS2), E.088899 (ProSAP-interacting protein 1), E.091483 (FH), E.114388 (NPRL2), E.114861 (FOXP1), E.135914 (HTR2B), E.197837 (HIST4H4), E.127720 (C12orf26; METTL25), E.123416 (TUBA1B), E.047410 (TPR), E.117748 (RPA2), E.133835 (HSD17B4), E.067248 (DHX29), E.121879 (PIK3CA), E.132589 (FLOT2), E.136750 (GAD2), E.160789 (LMNA), E.166329, E.170088 (TMEM192), E.175946 (KLHL38), E.178163 (ZNF518B), E.182217 (HIST2H4B), E.184470 (TXNRD2), E.110321 (EIF4G2), E.171861 (RNMTL1), E.065978 (YBX1), E.115738 (ID2), E.143294 (PRCC), E.158042 (MRPL17), E.169093 (ASMTL), E.090565 (RAB11FIP3), E.185591 (SP1), E.156304 (SCAF4), E.092978 (GPATCH2), E.100056 (DGCR14), E.100583 (SAMD15), E.105723 (GSK3A), E.107551 (RASSF4), E.107581 (EIF3A), E.107890 (ANKRD26), E.110104 (CCDC86), E.112584 (FAM120B), E.113580 (NR3C1), E.114491 (UMPS), E.137312 (FLOT1), E.137955 (RABGGTB), E.141994 (DUS3L), E.147044 (CASK), E.152818 (UTRN), E.180667 (YOD1), E.184916 (JAG2), E.196526 (AFAP1), E.198783 (ZNF830), E.108465 (CDK5RAP3), E.156515 (HK1), E.036448 (MYOM2), E.061918 (GUCY1B3), E.070785 (EIF2B3), E.116044 (NFE2L2), E.128311 (TST), E.131473 (ACLY), E.132716 (DCAF8), E.138363 (ATIC), E.166596 (WDR16), E.170027 (YWHAG), E.174021 (GNG5), E.203879 (GDI1), E.160049 (DFFA), E.010810 (FYN), E.051596 (THOC3), E.006453 (BAII-associated protein 2-like 1), E.126945 (HNRNPH2), E.165695 (AK8), E.069869 (NEDD4), E.111801 (BTN3A3), E.112232 (KHDRBS2), E.128626 (MRPS12), E.129636 (ITFG1), E.137948 (BRDT), E.147257 (GPC3), E.155380 (SLC16A1), E.159692 (CTBP1), E.166833 (NAV2), E.172466 (ZNF24), E.175110 (MRPS22), E.176102 (CSTF3), E.179388 (EGR3), E.185359 (HGS), E.198001 (IRAK4), E.100603 (SNW1), E.162641 (AKNAD1), E.069712 (KIAA1107), E.073756 (PTGS2), E.077522 (ACTN2), E.101639 (CEP192), E.106633 (GCK), E.115241 (PPM1G), E.116649 (SRM), E.120370 (GORAB), E.124143 (ARHGAP40), E.127948 (POR), E.129315 (CCNT1), E.132646 (PCNA), E.135740 (SLC9A5), E.151726 (ACSL1), E.154380 (ENAH), E.157103 (SLC6A1), E.163930 (BAP1), E.164488 (DACT2), E.164754 (RAD21), E.175220 (ARHGAP1), E.180318 (ALX1), E.181234 (TMEM132C), E.197081 (IGF2R), E.092871 (RFFL), E.163644 (PPM1K), E.171723 (GPHN), E.108953 (YWHAE), E.072110 (ACTN1), E.077097 (TOP2B), E.090889 (KIF4A), E.114331 (ACAP2), E.114867 (EIF4G1), E.117593 (DARS2), E.118523 (CTGF), E.120915 (EPHX2), E.134759 (ELP2), E.138061 (CYP1B1), E.140743 (CDR2), E.151247 (EIF4E), E.152942 (RAD17), E.160685 (ZBTB7B), E.163923 (RPL39L), E.167642 (SPINT2), E.167996 (FTH1), E.185736 (ADARB2), E.198841 (KTI12), E.185860 (C1orf10), E.160226 (C21orf2), E.070814 (TCOF1), E.124749 (COL21A1), E.154639 (CXADR), E.065485 (PDIA5), E.023909 (GCLM), E.100714 (MTHFD1), E.108387 (SEPT4), E.160867 (FGFR4), E.134684 (YARS), E.123080 (CDKN2C), E.065548 (ZC3H15), E.116455 (WDR77), E.117448 (AKR1A1), E.100393 (EP300), E.138160 (KIF11), E.166263 (STXBP4), E.173473 (SMARCC1), E.124942 (AHNAK), E.174842 (GLMN), E.180198 (RCC1), E.185499 (MUC1), E.143947 (RPS27A), E.170315 (UBB), E.003402 (CFLAR), E.137055 (PLAA), E.142606 (MMEL1), E.147697 (GSDMC), E.163110 (PDLIM5), E.135842 (FAM129A), E.160691 (SHC1), E.197157 (SND1), E.029725 (RABEP1), E.127946 (HIP1), E.001036 (FUCA2), E.109846 (CRYAB), E.183831 (ANKRD45), E.189283 (FHIT), E.092820 (EZR), E.104067 (TJP1), E.120159 (C9orf82; CAAP1), E.154864 (PIEZO2), E.196975 (ANXA4), E.105220 (GPI), E.127914 (AKAP9), E.135870 (RC3H1), E.026508 (CD44), E.089154 (GCN1L1), E.100311 (PDGFB), E.119383 (PPP2R4), E.075624 (ACTB), E.177409 (SAMD9L), E.177731 (FLII), E.015676 (NUDCD3), E.146457 (WTAP), E.178950 (GAK), E.167110 (GOLGA2) |
| Prostate vesicle | LAMP2, ACPP, CTNNA1, HEBP2, ISOC2, HNRNPC, HNRNPM, TOMM22, TOM1, ACO2, KRT18, HSPA9, LMNB1, SPR, PPL, ALDH6A1, HNRNPA2B1, ATXN1, SMARCA4, ECHS1, PAICS, ILF3, PSME3, COX5B, RAB1A, SCARB2, HADH, ESD, SORD, ILF2, CALM2, ATP5A1, TGOLN2, ANGPTL4, ALCAM, KRT2, PC, NPM1, C1orf116, GPC6, ALDH1A3, HIST1H1C, XRCC6, HNRNPAB, PSAP, CDH1, SCAMP2, VASP, CD9, ATP1B3, HSD17B10, APAF1, EIF2C2, RAB5A, CFL2, FARSA, XPNPEP3, ENTPD4, APLP2, NUCB1, RAB3D, VEGFA, HPS3, TSNAXIP1, HNRNPL, PSMB7, GNA12, NONO, FOLH1, PRKAR2A, PHB, HIST3H3, MAP7, VCP, U2AF2, FUS, FKBP5, |

TABLE 4-continued

Illustrative Biomarkers

| Illustrative Class | Biomarkers |
|---|---|
| | NDRG1, ATP1A3, NCL, RPL36, KRT8, ClGALT1C1, FASN, PTBP1, TXNDC16, DNAJC5, SLC37A2, HNRNPK, VDAC2, PRDX2, TALDO1, USP14, PSMD7, HSPE1, DNAJB1, YWHAZ, RAB3B, CORO1B, MDH2, HIST1H3A, LAMP1, STC2, DSTN, SLC20A2, ENPP4, WIZ, HSP90AB1, IDH3B, ECH1, Cl QBP, SET, TNFSF18, ITGB7, SPOCK1, EIF4A2, CCT3, CLDN3, EEF2, LRRC57, RUVBL2, CLDN5, APPL2, TM9SF2, EIF4A3, DBI, DBF4B, SVIP, CD151, ALOX5, SLC9A3R2, RAB27B, DLG1, ARCN1, CHCHD3, RAB5B, RPS25, RPL10, DDAH1, HSP90B1, CTNNB1, PSMD2, PKP3, FLNB, EFTUD2, GLO1, PRKCSH, TMBIM1, SEC31A, TMED10, RPL14, MATR3, APEX1, B4GALT1, HNRNPA1, CPD, HSPA1A, CAPN1, CHRDL2, SPEN, SDF4, NAPA, SYNGR2, CHMP3, CNDP2, CCDC64B, SERINC5, VPS37C, DNPEP, CLDN7, KTN1, SERPINB6, ATP5B, CANX, AKT1, TTBK2, DDX1, DLD, LNPEP, LTBP2, LRPPRC, EPS8, AZGP1, VPS28, DHCR7, CIB1, DDX39B, HIST1H4B, UGDH, HSPD1, B2M, TOLLIP, CD276, CYCS, CUL3, GDI2, LLGL2, XRCC5, CTTN, PHGDH, CST3, RBL2, SLC1A5, CD46, VAMP8, CLTA, ACSL3, MRPS26, SNX9, GLUD1, TMED4, PTPN13, AP1G1, SYT9, DCTN2, IDH2, GLUD2, TMED9, CLDN4, GM2A, CD2AP, MBD5, SERBP1, NBL1, PRKACB, GGCT, PRDX6, DHX9, TUBA3E, TUBA1C, TUBA3C, ERP29, SOD2, KRT19, TUBA3D, AARS, COMT, MUM1L1, CDH5, ECE1, ACAT1, ENDOD1, TUBAE, ETFB, NME2, CS, VBP1, RAB9A, TXNRD1, LIF, BAIAP2, HIST1H3H, GRN, HIBADH, H3F3B, CUL4B, HNRNPR, YWHAQ, PKHD1, TUBA1A, PARK7, ERLIN2, PDIA4, TUBA4A, PRKCD, ANXA3, H3F3A, PTP4A2, PDIA3, ETFA, CYB5R1, CRTAP, OXSR1, YES1, EPCAM, ARHGDIA, DIABLO, SLC9A3R1, BLVRB, P4HA1, HIST1H3B, ACTN4, UBC, FH, HIST4H4, TUBA1B, HSD17B4, PIK3CA, FLOT2, LMNA, TMEM192, HIST2H4B, YBX1, EIF3A, FLOT1, UTRN, HK1, ACLY, ATIC, YWHAG, GNG5, GDI1, HNRNPH2, NEDD4, BTN3A3, SLC16A1, HGS, ACTN2, SRM, PCNA, ACSL1, RAD21, ARHGAP1, IGF2R, YWHAE, ACTN1, EIF4G1, EPHX2, EIF4E, FTH1, CXADR, MTHFD1, AKR1A1, STXBP4, AHNAK, MUC1, RPS27A, UBB, PDLIM5, FAM129A, SND1, FUCA2, CRYAB, EZR, TJP1, ANXA4, GPI, AKAP9, CD44, GCN1L1, ACTB, FLII, NUDCD3 |
| Prostate Cancer vesicles | EGFR, GLUD2, ANXA3, APLP2, BclG, Cofilin 2/cfL2, DCTN-50/DCTN2, DDAH1, ESD, FARSLA, GITRL, PRKCSH, SLC20A2, Synaptogyrin 2/SYNGR2, TM9SF2, Calnexin, TOMM22, NDRG1, RPL10, RPL14, USP14, VDAC2, LLGL2, CD63, CD81, uPAR/CD87, ADAM 9, BDKRB2, CCR5, CCT2 (TCP1-beta), PSMA, PSMA1, HSPB1, VAMP8, Rab1A, B4GALT1, Aspartyl Aminopeptidase/Dnpep, ATPase Na+/K+ beta 3/ATP1B3, BDNF, ATPB, beta 2 Microglobulin, Calmodulin 2/CALM2, CD9, XRCC5/Ku80, SMARCA4, TOM1, Cytochrome C, Hsp10/HSPE1, COX2/PTGS2, Claudin 4/CLDN4, Cytokeratin 8, Cortactin/CTTN, DBF4B /DRF1, ECH1, ECHS1, GOLPH2, ETS1, DIP13B/app12, EZH2/KMT6, GSTP1, hK2/Kif2a, IQGAP1, KLK13, Lamp-2, GM2A, Hsp40/DNAJB1, HADH/HADHSC, Hsp90B, Nucleophosmin, p130/RBL2, PHGDH, RAB3B, ANXA1, PSMD7, PTBP1, Rab5a, SCARB2, Stanniocalcin 2/STC2, TGN46/TGOLN2, TSNAXIP1, ANXA2, CD46, KLK14, IL1alpha, hnRNP C1 + C2, hnRNP A1, hnRNP A2B1, Claudin 5, CORO1B, Integrin beta 7, CD41, CD49d, CDH2, COX5b, IDH2, ME1, PhIP, ALDOA, EDNRB/EDN3, MTA1, NKX3-1, TMPRSS2, CD10, CD24, CDH1, ADAM10, B7H3, CD276, CHRDL2, SPOCK1, VEGFA, BCHE, CD151, CD166/ALCAM, CSE1L, GPC6, CXCR3, GAL3, GDF15, IGFBP-2, HGF, KLK12, ITGAL, KLK7, KLK9, MMP 2, MMP 25, MMP10, TNFRI, Notch1, PAP-same as ACPP, PTPN13/PTPL1, seprase/FAP, TNFR1, TWEAK, VEGFR2, E-Cadherin, Hsp60, CLDN3-Claudin3, KLK6, KLK8, EDIL3 (del-1), APE1, MMP 1, MMP3, nAnS, PSP94/MSP/IGBF, PSAP, RPL19, SET, TGFB, TGM2, TIMP-1, TNFRII, MDH2, PKP1, Cystatin C, Trop2/TACSTD2, CCR2/CD192, hnRNP M1-M4, CDKN1A, CGA, Cytokeratin 18, EpoR, GGPS1, FTL (light and heavy), GM-CSF, HSP90AA1, IDH3B, MKI67/Ki67, LTBP2, KLK1, KLK4, KLK5, LDH-A, Nav1.7/SCN9A, NRP1/CD304, PIP3/BPNT1, PKP3, CgA, PRDX2, SRVN, ATPase Na+/K+ alpha 3/ATP1A3, SLC3A2/CD98, U2AF2, TLR4 (CD284), TMPRSS1, TNFα, uPA, GloI, ALIX, PKM2, FABP5, CAV1, TLR9/CD289, ANXA4, PLEKHC1/Kindlin-2, CD71/TRFR, MBD5, SPEN/ RBM15, LGALS8, SLC9A3R2, ENTPD4, ANGPTL4, p97/VCP, TBX5, PTEN, Prohibitin, LSP1, HOXB13, DDX1, AKT1, ARF6, EZR, H3F3A, CIB1, Ku70 (XRCC6), KLK11, TMBIM6, SYT9, APAF1, CLDN7, MATR3, CD90/THY1, Tollip, NOTCH4, 14-3-3 zeta/beta, ATP5A1, DLG1, GRP94, FKBP5/FKBP51, LAMP1, LGALS3BP, GDI2, HSPA1A, NCL, KLK15, Cytokeratin basic, EDN-3, AGR2, KLK10, BRG1, FUS, Histone H4, hnRNP L, Catenin Alpha 1, hnRNP K (F45)*, MMP7*, DBI*, beta catenin, CTH, CTNND2, Ataxin 1, Proteasome 20S beta 7, ADE2, EZH2, GSTP1, Lamin B1, Coatomer Subunit Delta, ERAB, Mortalin, PKM2, IGFBP-3, CTNND1/delta 1-catenin/p120-catenin, PKA R2, NONO, Sorbitol Dehydrogenase, Aconitase 2, VASP, Lipoamide Dehydrogenase, AP1G1, GOLPH2, ALDH6A1, AZGP1, Ago2, CNDP2, Nucleobindin-1, SerpinB6, RUVBL2, Proteasome 19S 10B, SH3PX1, SPR, Destrin, MDM4, FLNB, FASN, PSME |

TABLE 4-continued

Illustrative Biomarkers

| Illustrative Class | Biomarkers |
| --- | --- |
| Prostate Cancer vesicles | 14-3-3 zeta/beta, Aconitase 2, ADAM 9, ADAM10, ADE2, AFM, Ago2, AGR2, AKT1, ALDH1A3, ALDH6A1, ALDOA, ALIX, ANGPTL4, ANXA1, ANXA2, ANXA3, ANXA3, ANXA4, AP1G1, APAF1, APE1, APLP2, APLP2, ARF6, Aspartyl Aminopeptidase/Dnpep, Ataxin 1, ATP5A1, ATPase Na+/K+ alpha 3/ATP1A3, ATPase Na+/K+ beta 3/ATP1B3, ATPase Na+/K+ beta 3/ATP1B3, ATPB, AZGP1, B4GALT1, B7H3, BCHE, BclG, BDKRB2, BDNF, BDNF, beta 2 Microglobulin, beta catenin, BRG1, CALM2, Calmodulin 2/<br>CALM2, Calnexin, Calpain 1, Catenin Alpha 1, CAV1, CCR2/CD192, CCR5, CCT2 (TCP1-beta), CD10, CD151, CD166/ALCAM, CD24, CD276, CD41, CD46, CD49d, CD63, CD71/TRFR, CD81, CD9, CD9, CD90/THY1, CDH1, CDH2, CDKN1A, CGA, CgA, CHRDL2, CIB1, CIB1, Claudin 4/CLDN4, Claudin 5, CLDN3, CLDN3-Claudin3, CLDN4, CLDN7, CNDP2, Coatomer Subunit Delta, Cofilin 2 /cfL2, CORO1B, Cortactin/CTTN, COX2/PTGS2, COX5b, CSE1L, CTH, CTNND1/delta 1-catenin/p120-catenin, CTNND2, CXCR3, CYCS, Cystatin C, Cytochrome C, Cytokeratin 18, Cytokeratin 8, Cytokeratin basic, DBF4B /DRF1, DBI*, DCTN-50/DCTN2, DDAH1, DDAH1, DDX1, Destrin, DIP13B/app12, DIP13B /appl2, DLG1, Dnpep, E-Cadherin, ECH1, ECHS1, ECHS1, EDIL3 (del-1), EDN-3, EDNRB/EDN3, EGFR, EIF4A3, ENTPD4, EpoR, EpoR, ERAB, ESD, ESD, ETS1, ETS1, ETS-2, EZH2, EZH2 / KMT6, EZR, FABP5, FARSLA, FASN, FKBP5/FKBP51, FLNB, FTL (light and heavy), FUS, GAL3, gamma-catenin, GDF15, GDI2, GGPS1, GGPS1, GITRL, Glol, GLUD2, GM2A, GM-CSF, GOLM1/GOLPH2 Mab; clone 3B10, GOLPH2, GOLPH2, GPC6, GRP94, GSTP1, GSTP1, H3F3A, HADH/HADHSC, HGF, HIST1H3A, Histone H4, hK2/Kif2a, hnRNP A1, hnRNP A2B1, hnRNP C1 + C2, hnRNP K (F45)*, hnRNP L, hnRNP M1-M4, HOXB13, Hsp10/ HSPE1, Hsp40/DNAJB1, Hsp60, HSP90AA1, Hsp90B, HSPA1A, HSPB1, IDH2, IDH3B, IDH3B, IGFBP-2, IGFBP-3, IgGl, IgG2A, IgG2B, IL1alpha, IL1alpha, Integrin beta 7, IQGAP1, ITGAL, KLHL12/C3IP1, KLK1, KLK10, KLK11, KLK12, KLK13, KLK14, KLK15, KLK4, KLKS, KLK6, KLK7, KLK8, KLK9, Ku70 (XRCC6), Lamin B1, LAMP1, Lamp-2, LDH-A, LGALS3BP, LGALS8, Lipoamide Dehydrogenase, LLGL2, LSP1, LSP1, LTBP2, MATR3, MBD5, MDH2, MDM4, MEL MKI67/Ki67, MMP 1, MMP 2, MMP 25, MMP10, MMP-14/MT1-MMP, MMP3, MMP7*, Mortalin, MTA1, nAnS, nAnS, Nav1.7/SCN9A, NCL, NDRG1, NKX3-1, NONO, Notch1, NOTCH4, NRP1/CD304, Nucleobindin-1, Nucleophosmin, p130 /RBL2, p97/VCP, PAP-same as ACPP, PHGDH, PhIP, PIP3/BPNT1, PKA R2, PKM2, PKM2, PKP1, PKP3, PLEKHC1/Kindlin-2, PRDX2, PRKCSH, Prohibitin, Proteasome 19S 10B, Proteasome 20S beta 7, PSAP, PSMA, PSMA1, PSMA1, PSMD7, PSMD7, PSME3, PSP94/MSP/IGBF, PTBP1, PTEN, PTPN13/PTPL1, Rab1A, RAB3B, Rab5a, Rad51b, RPL10, RPL10, RPL14, RPL14, RPL19, RUVBL2, SCARB2, seprase/FAP, SerpinB6, SET, SH3PX1, SLC20A2, SLC3A2/CD98, SLC9A3R2, SMARCA4, Sorbitol Dehydrogenase, SPEN/RBM15, SPOCK1, SPR, SRVN, Stanniocalcin 2/STC2, STEAP1, Synaptogyrin 2/SYNGR2, Syndecan, SYNGR2, SYT9, TAF1B/ GRHL1, TBX5, TGFB, TGM2, TGN46/TGOLN2, TIMP-1, TLR3, TLR4 (CD284), TLR9/ CD289, TM9SF2, TMBIM6, TMPRSS1, TMPRSS2, TNFR1, TNFRI, TNFRII, TNFSF18/ GITRL, TNFa, TNFa, Tollip, TOM1, TOMM22, Trop2 / TACSTD2, TSNAXIP1, TWEAK, U2AF2, uPA, uPAR / CD87, USP14, USP14, VAMPS, VASP, VDAC2, VEGFA, VEGFR1/FLT1, VEGFR2, VPS28, XRCC5/Ku80, XRCC5/Ku80 |
| Prostate Vesicles/ General Vesicles | EpCAM/TROP-1, HSA, Fibrinogen, GAPDH, Cholesterol Oxidase, MMP7, Complement Factor D/Adipsin, E-Cadherin, Transferrin Antibody, eNOS, IgM, CD9, Apolipoprotein B (Apo B), Ep-CAM, TBG, Kallekerin 3, IgA, IgG, Annexin V, IgG, Pyruvate Carboxylase, trypsin, AFP, TNF RI/TNFRSF1A, Aptamer CAR023, Aptamer CAR024, Aptamer CAR025, Aptamer CAR026 |
| Ribonucleoprotein complexes & vesicles | GW182, Agog, miR-let-7a, miR-16, miR-22, miR-148a, miR-451, miR-92a, CD9, CD63, CD81 |
| Prostate Cancer vesicles | PCSA, Muc2, Adam10 |
| Prostate Cancer vesicles | Alkaline Phosphatase (AP), CD63, MyoD1, Neuron Specific Enolase, MAP1B, CNPase, Prohibitin, CD45RO, Heat Shock Protein 27, Collagen II, Laminin B1/b1, Gail, CDw75, bcl-<br>XL, Laminin-s, Ferritin, CD21, ADP-ribosylation Factor (ARF-6) |
| Prostate Cancer vesicles | CD56/NCAM-1, Heat Shock Protein 27/hsp27, CD45RO, MAP1B, MyoD1, CD45/T200/LCA, CD3zeta, Laminin-s, bcl-XL, Rad18, Gail, Thymidylate Synthase, Alkaline Phosphatase (AP), CD63, MMP-16 / MT3-MMP, Cyclin C, Neuron Specific Enolase, SIRP a1, Laminin B1/b1, Amyloid Beta (APP), SODD (Silencer of Death Domain),<br>CDC37, Gab-1, E2F-2, CD6, Mast Cell Chymase, Gamma Glutamylcysteine Synthetase (GCS) |
| Prostate Cancer vesicles | EpCAM, MMP7, PCSA, BCNP, ADAM10, KLK2, SPDEF, CD81, MFGE8, IL-8 |
| Prostate Cancer vesicles | EpCAM, KLK2, PBP, SPDEF, SSX2, SSX4 |
| Prostate Cancer vesicles | ADAM-10, BCNP, CD9, EGFR, EpCam, IL1B, KLK2, MMP7, p53, PBP, PCSA, SERPINB3, SPDEF, SSX2, SSX4 |
| Androgen Receptor (AR) pathway members in cMVs | GTF2F1, CTNNB1, PTEN, APPL1, GAPDH, CDC37, PNRC1, AES, UXT, RAN, PA2G4, JUN, BAG1, UBE2I, HDAC1, COX5B, NCOR2, STUB1, HIPK3, PXN, NCOA4 |

TABLE 4-continued

Illustrative Biomarkers

| Illustrative Class | Biomarkers |
|---|---|
| EGFR1 pathway members in cMVs | RALBP1, SH3BGRL, RBBP7, REPS1, SNRPD2, CEBPB, APPL1, MAP3K3, EEF1A1, GRB2, RAC1, SNCA, MAP2K3, CEBPA, CDC42, SH3KBP1, CBL, PTPN6, YWHAB, FOXO1, JAK1, KRT8, RALGDS, SMAD2, VAV1, NDUFA13, PRKCB1, MYC, JUN, RFXANK, HDAC1, HIST3H3, PEBP1, PXN, TNIP1, PKN2 |
| TNF-alpha pathway members in cMVs | BCL3, SMARCE1, RPS11, CDC37, RPL6, RPL8, PAPOLA, PSMC1, CASP3, AKT2, MAP3K7IP2, POLR2L, TRADD, SMARCA4, HIST3H3, GNB2L1, PSMD1, PEBP1, HSPB1, TNIP1, RPS13, ZFAND5, YWHAQ, COMMD1, COPS3, POLR1D, SMARCC2, MAP3K3, BIRC3, UBE2D2, HDAC2, CASP8, MCMI, PSMD7, YWHAG, NFKBIA, CAST, YWHAB, G3BP2, PSMD13, FBL, RELB, YWHAZ, SKP1, UBE2D3, PDCD2, HSP90AA1, HDAC1, KPNA2, RPL30, GTF2I, PFDN2 |
| Colorectal cancer | CD9, EGFR, NGAL, CD81, STEAP, CD24, A33, CD66E, EPHA2, Ferritin, GPR30, GPR110, MMP9, OPN, p53, TMEM211, TROP2, TGM2, TIMP, EGFR, DR3, UNC93A, MUC17, EpCAM, MUC1, MUC2, TSG101, CD63, B7H3 |
| Colorectal cancer | DR3, STEAP, epha2, TMEM211, unc93A, A33, CD24, NGAL, EpCam, MUC17, TROP2, TETS |
| Colorectal cancer | A33, AFP, ALIX, ALX4, ANCA, APC, ASCA, AURKA, AURKB, B7H3, BANK1, BCNP, BDNF, CA-19-9, CCSA-2, CCSA-3&4, CD10, CD24, CD44, CD63, CD66 CEA, CD66e CEA, CD81, CD9, CDA, C-Erb2, CRMP-2, CRP, CRTN, CXCL12, CYFRA21-1, DcR3, DLL4, DR3, EGFR, Epcam, EphA2, FASL, FRT, GAL3, GDF15, GPCR (GPR110), GPR30, GRO-1, HBD 1, HBD2, HNP1-3, IL-1B, IL8, IMP3, L1CAM, LAMN, MACC-1, MGC20553, MCP-1, M-CSF, MIC1, MIF, MMP7, MMP9, MS4A1, MUC1, MUC17, MUC2, Ncam, NGAL, NNMT, OPN, p53, PCSA, PDGFRB, PRL, PSMA, PSME3, Reg IV, SCRN1, Sept-9, SPARC, SPON2, SPR, SRVN, TFF3, TGM2, TIMP-1, TMEM211, TNF-alpha, TPA, TPS, Trail-R2, Trail-R4, TrKB, TROP2, Tsg 101, TWEAK, UNC93A, VEGFA |
| Colorectal cancer | miR 92, miR 21, miR 9, miR 491 |
| Colorectal cancer | miR-127-3p, miR-92a, miR-486-3p, miR-378 |
| Colorectal cancer | TMEM211, MUC1, CD24 and/or GPR110 (GPCR 110) |
| Colorectal cancer | hsa-miR-376c, hsa-miR-215, hsa-miR-652, hsa-miR-582-5p, hsa-miR-324-5p, hsa-miR-1296, hsa-miR-28-5p, hsa-miR-190, hsa-miR-590-5p, hsa-miR-202, hsa-miR-195 |
| Colorectal cancer vesicle markers | A26C1A, A26C1B, A2M, ACAA2, ACE, ACOT7, ACP1, ACTA1, ACTA2, ACTB, ACTBL2, ACTBL3, ACTC1, ACTG1, ACTG2, ACTN1, ACTN2, ACTN4, ACTR3, ADAM10, ADSL, AGR2, AGR3, AGRN, AHCY, AHNAK, AKR1B10, ALB, ALDH16A1, ALDH1A1, ALDOA, ANXA1, ANXA11, ANXA2, ANXA2P2, ANXA4, ANXA5, ANXA6, AP2A1, AP2A2, APOA1, ARF1, ARF3, ARF4, ARF5, ARF6, ARHGDIA, ARPC3, ARPC5L, ARRDC1, ARVCF, ASCC3L1, ASNS, ATP1A1, ATP1A2, ATP1A3, ATP1B1, ATP4A, ATP5A1, ATP5B, ATP5I, ATP5L, ATP5O, ATP6AP2, B2M, BAIAP2, BAIAP2L1, BRI3BP, BSG, BUB3, C1orf58, C5orf32, CAD, CALM1, CALM2, CALM3, CAND1, CANX, CAPZA1, CBR1, CBR3, CCT2, CCT3, CCT4, CCT5, CCT6A, CCT7, CCT8, CD44, CD46, CD55, CD59, CD63, CD81, CD82, CD9, CDC42, CDH1, CDH17, CEACAM5, CFL1, CFL2, CHMP1A, CHMP2A, CHMP4B, CKB, CLDN3, CLDN4, CLDN7, CLIC1, CLIC4, CLSTN1, CLTC, CLTCL1, CLU, COL12A1, COPB1, COPB2, CORO1C, COX4I1, COX5B, CRYZ, CSPG4, CSRP1, CST3, CTNNA1, CTNNB1, CTNND1, CTTN, CYFIP1, DCD, DERA, DIP2A, DIP2B, DIP2C, DMBT1, DPEP1, DPP4, DYNC1H1, EDIL3, EEF1A1, EEF1A2, EEF1AL3, EEF1G, EEF2, EFNB1, EGFR, EHD1, EHD4, EIF2EIP, EIF3I, EIF4A1, EIF4A2, ENO1, ENO2, ENO3, EPHA2, EPHA5, EPHB1, EPHB2, EPHB3, EPHB4, EPPK1, ESD, EZR, F11R, F5, F7, FAM125A, FAM125B, FAM129B, FASLG, FASN, FAT, FCGBP, FER1L3, FKBP1A, FLNA, FLNB, FLOT1, FLOT2, G6PD, GAPDH, GARS, GCN1L1, GDI2, GK, GMDS, GNA13, GNAI2, GNAI3, GNAS, GNB1, GNB2, GNB2L1, GNB3, GNB4, GNG12, GOLGA7, GPA33, GPI, GPRC5A, GSN, GSTP1, H2AFJ, HADHA, hCG_1757335, HEPH, HIST1H2AB, HIST1H2AE, HIST1H2AJ, HIST1H2AK, HIST1H4A, HIST1H4B, HIST1H4C, HIST1H4D, HIST1H4E, HIST1H4F, HIST1H4H, HIST1H4I, HIST1H4J, HIST1H4K, HIST1H4L, HIST2H2AC, HIST2H4A, HIST2H4B, HIST3H2A, HIST4H4, HLA-A, HLA-A29.1, HLA-B, HLA-C, HLA-E, HLA-H, HNRNPA2B1, HNRNPH2, HPCAL1, HRAS, HSD17B4, HSP90AA1, HSP90AA2, HSP90AA4P, HSP90AB1, HSP90AB2P, HSP90AB3P, HSP90B1, HSPA1A, HSPA1B, HSPAIL, HSPA2, HSPA4, HSPA5, HSPA6, HSPA7, HSPA8, HSPA9, HSPD1, HSPE1, HSPG2, HYOU1, IDH1, IFITM1, IFITM2, IFITM3, IGH IGHG2, IGHG3, IGHG4, IGHM, IGHV4-31, IGK@, IGKC, IGHV1-5, IGKV2-24, IGKV3-20, IGSF3, IGSF8, IQGAP1, IQGAP2, ITGA2, ITGA3, ITGA6, ITGAV, ITGB1, ITGB4, JUP, KIAA0174, KIAA1199, KPNB1, KRAS, KRT1, KRT10, KRT13, KRT14, KRT15, KRT16, KRT17, KRT18, KRT19, KRT2, KRT20, KRT24, KRT25, KRT27, KRT28, KRT3, KRT4, KRT5, KRT6A, KRT6B, KRT6C, KRT7, KRT75, KRT76, KRT77, KRT79, KRT8, KRT9, LAMAS, LAMP1, LDHA, LDHB, LFNG, LGALS3, LGALS3BP, LGALS4, LIMA1, LIN7A, LIN7C, LOC100128936, LOC100130553, LOC100133382, LOC100133739, LOC284889, LOC388524, LOC388720, LOC442497, LOC653269, LRP4, LRPPRC, LRSAM1, LSR, LYZ, MAN1A1, MAP4K4, MARCKS, MARCKSL1, METRNL, MFGE8, MICA, MIF, MINK', MITD1, MMP7, MOBKL1A, MSN, MTCH2, MUC13, MYADM, MYH10, MYH11, MYH14, MYH9, MYL6, MYL6B, MYO1C, MYO1D, NARS, NCALD, NCSTN, NEDD4, NEDD4L, NME1, NME2, NOTCH1, NQO1, NRAS, P4HB, PCBP1, PCNA, PCSK9, PDCD6, PDCD6IP, PDIA3, PDXK, PEBP1, PFN1, PGK1, PHB, PHB2, PKM2, PLEC1, PLEKHB2, PLSCR3, PLXNAL PLXNB2, PPIA, PPIB, PPP2R1A, PRDX1, PRDX2, PRDX3, PRDX5, PRDX6, PRKAR2A, PRKDC, PRSS23, PSMA2, PSMC6, PSMD11, PSMD3, PSME3, PTGFRN, PTPRF, PYGB, QPCT, QSOX1, RAB10, RAB11A, |

TABLE 4-continued

Illustrative Biomarkers

| Illustrative Class | Biomarkers |
|---|---|
| | RAB11B, RAB13, RAB14, RAB15, RAB1A, RAB1B, RAB2A, RAB33B, RAB35, RAB43, RAB4B, RAB5A, RAB5B, RAB5C, RAB6A, RAB6B, RAB7A, RAB8A, RAB8B, RAC1, RAC3, RALA, RALB, RAN, RANP1, RAP1A, RAP1B, RAP2A, RAP2B, RAP2C, RDX, REG4, RHOA, RHOC, RHOG, ROCK2, RP11-631M21.2, RPL10A, RPL12, RPL6, RPL8, RPLP0, RPLP0-like, RPLP1, RPLP2, RPN1, RPS13, RPS14, RPS15A, RPS16, RPS18, RPS20, RPS21, RPS27A, RPS3, RPS4X, RPS4Y1, RPS4Y2, RPS7, RPS8, RPSA, RPSAP15, RRAS, RRAS2, RUVBEL RUVBL2, S100A10, S100A11, S100A14, S100A16, S100A6, S100P, SDC1, SDC4, SDCBP, SDCBP2, SERINC1, SERINC5, SERPINA1, SERPINF1, SETD4, SFN, SLC12A2, SLC12A7, SLC16A1, SLC1A5, SLC25A4, SLC25A5, SLC25A6, SLC29A1, SLC2A1, SLC3A2, SLC44A1, SLC7A5, SLC9A3R1, SMPDL3B, SNAP23, SND1, SOD1, SORT1, SPTAN1, SPTBN1, SSBP1, SSR4, TACSTD1, TAGLN2, TBCA, TCEB1, TCP1, TF, TFRC, THBS1, TJP2, TKT, TMED2, TNFSF10, TNIK, TNKS1BP1, TNPO3, TOLLIP, TOMM22, TPI1, TPM1, TRAP1, TSG101, TSPAN1, TSPAN14, TSPAN15, TSPAN6, TSPAN8, TSTA3, TTYH3, TUBA1A, TUBA1B, TUBA1C, TUBA3C, TUBA3D, TUBA3E, TUBA4A, TUBA4B, TUBAE, TUBB, TUBB2A, TUBB2B, TUBB2C, TUBB3, TUBB4, TUBB4Q, TUBB6, TUFM, TXN, UBA1, UBA52, UBB, UBC, UBE2N, UBE2V2, UGDH, UQCRC2, VAMP1, VAMP3, VAMP5, VCP, VIL1, VPS25, VPS28, VPS35, VPS36, VPS37B, VPS37C, WDR1, YWHAB, YWHAE, YWHAG, YWHAH, YWHAQ, YWHAZ |
| Colorectal Cancer | hsa-miR-16, hsa-miR-25, hsa-miR-125b, hsa-miR-451, hsa-miR-200c, hsa-miR-140-3p, hsa-miR-658, hsa-miR-370, hsa-miR-1296, hsa-miR-636, hsa-miR-502-5p |
| Breast cancer | miR-21, miR-155, miR-206, miR-122a, miR-210, miR-21, miR-155, miR-206, miR-122a, miR-210, let-7, miR-10b, miR-125a, miR-125b, miR-145, miR-143, miR-145, miR-1b |
| Breast cancer | GAS5 |
| Breast cancer | ER, PR, HER2, MUC1, EGFR, KRAS, B-Raf, CYP2D6, hsp70, MART-1, TRP, HER2, hsp70, MART-1, TRP, HER2, ER, PR, Class III b-tubulin, VEGFA, ETV6-NTRK3, BCA-225, hsp70, MART', ER, VEGFA, Class III b-tubulin, HER2/neu (e.g., for Her2+ breast cancer), GPR30, ErbB4 (JM) isoform, MPR8, MISIIR, CD9, EphA2, EGFR, B7H3, PSM, PCSA, CD63, STEAP, CD81, ICAM1, A33, DR3, CD66e, MFG-E8, TROP-2, Mammaglobin, Hepsin, NPGP/NPFF2, PSCA, 5T4, NGAL, EpCam, neurokinin receptor-1 (NK-1 or NK-1R), NK-2, Pai-1, CD45, CD10, HER2/ERBB2, AGTR1, NPY1R, MUC1, ESA, CD133, GPR30, BCA225, CD24, CA15.3 (MUC1 secreted), CA27.29 (MUC1 secreted), NMDAR1, NMDAR2, MAGEA, CTAG1B, NY-ESO-1, SPB, SPC, NSE, PGP9.5, progesterone receptor (PR) or its isoform (PR(A) or PR(B)), P2RX7, NDUFB7, NSE, GAL3, osteopontin, CHI3L1, IC3b, mesothelin, SPA, AQP5, GPCR, hCEA-CAM, PTP IA-2, CABYR, TMEM211, ADAM28, UNC93A, MUC17, MUC2, IL10R-beta, BCMA, HVEM/TNFRSF14, Trappin-2, Elafin, ST2/IL1 R4, TNFRF14, CEACAM1, TPA1, LAMP, WF, WH1000, PECAM, BSA, TNFR |
| Breast cancer | CD9, MIS Rii, ER, CD63, MUC1, HER3, STAT3, VEGFA, BCA, CA125, CD24, EPCAM, ERB B4 |
| Breast cancer | CD10, NPGP/NPFF2, HER2/ERBB2, AGTR1, NPY1R, neurokinin receptor-1 (NK-1 or NK-1R), NK-2, MUC1, ESA, CD133, GPR30, BCA225, CD24, CA15.3 (MUC1 secreted), CA27.29 (MUC1 secreted), NMDAR1, NMDAR2, MAGEA, CTAG1B, NY-ESO-1 |
| Breast cancer | SPB, SPC, NSE, PGP9.5, CD9, P2RX7, NDUFB7, NSE, GAL3, osteopontin, CHI3L1, EGFR, B7H3, IC3b, MUC1, mesothelin, SPA, PCSA, CD63, STEAP, AQP5, CD81, DR3, PSM, GPCR, EphA2, hCEA-CAM, PTP IA-2, CABYR, TMEM211, ADAM28, UNC93A, A33, CD24, CD10, NGAL, EpCam, MUC17, TROP-2, MUC2, IL10R-beta, BCMA, HVEM/TNFRSF14, Trappin-2 Elafin, ST2/IL1 R4, TNFRF14, CEACAM1, TPA1, LAMP, WF, WH1000, PECAM, BSA, TNFR |
| Breast cancer | BRCA, MUC-1, MUC 16, CD24, ErbB4, ErbB2 (HER2), ErbB3, HSP70, Mammaglobin, PR, PR(B), VEGFA |
| Breast cancer | CD9, HSP70, Gal3, MIS, EGFR, ER, ICB3, CD63, B7H4, MUC1, DLL4, CD81, ERB3, VEGF, BCA225, BRCA, CA125, CD174, CD24, ERB2, NGAL, GPR30, CYFRA21, CD31, cMET, MUC2, ERBB4 |
| Breast cancer | CD9, EphA2, EGFR, B7H3, PSMA, PCSA, CD63, STEAP, CD81, STEAP1, ICAM1 (CD54), PSMA, A33, DR3, CD66e, MFG-8e, TMEM211, TROP-2, EGFR, Mammoglobin, Hepsin, NPGP/NPFF2, PSCA, 5T4, NGAL, NK-2, EpCam, NK-1R, PSMA, 5T4, PAI-1, CD45 |
| Breast cancer | PGP9.5, CD9, HSP70, gal3-b2c10, EGFR, iC3b, PSMA, PCSA, CD63, MUC1, DLL4, CD81, B7-H3, HER 3 (ErbB3), MART-1, PSA, VEGF A, TIMP-1, GPCR GPR110, EphA2, MMP9, mmp7, TMEM211, UNC93a, BRCA, CA125 (MUC16), Mammaglobin, CD174 (Lewis y), CD66e CEA, CD24 c.sn3, C-erbB2, CD10, NGAL, epcam, CEA (carcinoembryonic Antigen), GPR30, CYFRA21-1, OPN, MUC17, hVEGFR2, MUC2, NCAM, ASPH, ErbB4, SPB, SPC, CD9, MS4A1, EphA2, MIS RII, HER2 (ErbB2), ER, PR (B), MRP8, CD63, B7H4, TGM2, CD81, DR3, STAT 3, MACC-1, TrKB, IL 6 Unc, OPG-13, IL6R, EZH2, SCRN1, TWEAK, SERPINB3, CDAC1, BCA-225, DR3, A33, NPGP/NPFF2, TIMP1, BDNF, FRT, Ferritin heavy chain, seprase, p53, LDH, HSP, ost, p53, CXCL12, HAP, CRP, Gro-alpha, Tsg 101, GDF15 |
| Breast cancer | CD9, HSP70, Gal3, MIS (RII), EGFR, ER, ICB3, CD63, B7H4, MUC1, CD81, ERB3, MART1, STAT3, VEGF, BCA225, BRCA, CA125, CD174, CD24, ERB2, NGAL, GPR30, CYFRA21, CD31, cMET, MUC2, ERB4, TMEM211 |

TABLE 4-continued

Illustrative Biomarkers

| Illustrative Class | Biomarkers |
|---|---|
| Breast Cancer | 5T4 (trophoblast), ADAM10, AGER/RAGE, APC, APP (β-amyloid), ASPH (A-10), B7H3 (CD276), BACE1, BAI3, BRCA1, BDNF, BIRC2, C1GALT1, CA125 (MUC16), Calmodulin 1, CCL2 (MCP-1), CD9, CD10, CD127 (IL7R), CD174, CD24, CD44, CD63, CD81, CEA, CRMP-2, CXCR3, CXCR4, CXCR6, CYFRA 21, derlin 1, DLL4, DPP6, E-CAD, EpCaM, EphA2 (H-77), ER(1) ESR1 α, ER(2) ESR2 β, Erb B4, Erbb2, erb3 (Erb-B3), PA2G4, FRT (FLT1), Ga13, GPR30 (G-coupled ER1), HAP1, HER3, HSP-27, HSP70, IC3b, IL8, insig, junction plakoglobin, Keratin 15, KRAS, Mammaglobin, MART1, MCT2, MFGE8, MMP9, MRP8, Muc1, MUC17, MUC2, NCAM, NG2 (CSPG4), Ngal, NHE-3, NT5E (CD73), ODC1, OPG, OPN, p53, PARK7, PCSA, PGP9.5 (PARKS), PR(B), PSA, PSMA, RAGE, STXBP4, Survivin, TFF3 (secreted), TIMP1, TIMP2, TMEM211, TRAF4 (scaffolding), TRAIL-R2 (death Receptor 5), TrkB, Tsg 101, UNC93a, VEGF A, VEGFR2, YB-1, VEGFR1, GCDPF-15 (PIP), BigH3 (TGFb1-induced protein), 5HT2B (serotonin receptor 2B), BRCA2, BACE 1, CDH1-cadherin |
| Breast Cancer | AK5.2, ATP6V1B1, CRABP1 |
| Breast Cancer | DST.3, GATA3, KRT81 |
| Breast Cancer | AK5.2, ATP6V1B1, CRABP1, DST.3, ELF5, GATA3, KRT81, LALBA, OXTR, RASL10A, SERHL, TFAP2A.1, TFAP2A.3, TFAP2C, VTCN1 |
| Breast Cancer | TRAP; Renal Cell Carcinoma; Filamin; 14.3.3, Pan; Prohibitin; c-fos; Ang-2; GSTmu; Ang-1; FHIT; Rad51; Inhibin alpha; Cadherin-P; 14.3.3 gamma; p18INK4c; P504S; XRCC2; Caspase 5; CREB-Binding Protein; Estrogen Receptor; IL17; Claudin 2; Keratin 8; GAPDH; CD1; Keratin, LMW; Gamma Glutamylcysteine Synthetase(GCS)/Glutamate-cysteine Ligase; a-B-Crystallin; Pax-5; MMP-19; APC; IL-3; Keratin 8 (phospho-specific Ser73); TGF-beta 2; ITK; Oct-2/; DJ-1; B7-H2; Plasma Cell Marker; Rad18; Estriol; Chk1; Prolactin Receptor; Laminin Receptor; Histone H1; CD45RO; GnRH Receptor; IP10/CRG2; Actin, Muscle Specific; S100; Dystrophin; Tubulin-a; CD3zeta; CDC37; GABA a Receptor 1; MMP-7 (Matrilysin); Heregulin; Caspase 3; CD56/NCAM-1; Gastrin 1; SREBP-1 (Sterol Regulatory Element Binding Protein-1); MEH1; PGP9.5; Factor VIII Related Antigen; ADP-ribosylation Factor (ARF-6); MHC II (HLA-DR) Ia; Survivin; CD23; G-CSF; CD2; Calretinin; Neuron Specific Enolase; CD165; Calponin; CD95/Fas; Urocortin; Heat Shock Protein 27/hsp27; Topo II beta; Insulin Receptor; Keratin 5/8; sm; Actin, skeletal muscle; CA19-9; GluR1; GRIP1; CD79a mb-1; TdT; HRP; CD94; CCK-8; Thymidine Phosphorylase; CD57; Alkaline Phosphatase (AP); CD59 / MACIF/MIRE/Protectin; GLUT-1; alpha-1-antitrypsin; Presenillin; Mucin 3 (MUC3); pS2; 14-3-3 beta; MMP-13 (Collagenase-3); Fli-1; mGluR5; Mast Cell Chymase; Laminin B1/b1; Neurofilament (160kDa); CNPase; Amylin Peptide; Gail; CD6; alpha-1-antichymotrypsin; E2F-2; MyoD1 |
| Ductal carcinoma in situ (DCIS) | Laminin B1/b1; E2F-2; TdT; Apolipoprotein D; Granulocyte; Alkaline Phosphatase (AP); Heat Shock Protein 27/hsp27; CD95/Fas; pS2; Estriol; GLUT-1; Fibronectin; CD6; CCK-8; sm; Factor VIII Related Antigen; CD57; Plasminogen; CD71/Transferrin Receptor; Keratin 5/8; Thymidine Phosphorylase; CD45/T200/LCA; Epithelial Specific Antigen; Macrophage; CD10; MyoD1; Gail; bcl-XL; hPL; Caspase 3; Actin, skeletal muscle; IP10/CRG2; GnRH Receptor; p35nck5a; ADP-ribosylation Factor (ARF-6); Cdk4 ; alpha-1-antitrypsin; IL17; Neuron Specific Enolase; CD56/NCAM-1; Prolactin Receptor; Cdk7; CD79a mb-1; Collagen IV; CD94; Myeloid Specific Marker; Keratin 10; Pax-5; IgM (m-Heavy Chain); CD45RO; CA19-9; Mucin 2; Glucagon; Mast Cell Chymase; MLH1; CD1; CNPase; Parkin; MHC II (HLA-DR) Ia; B7-H2; Chk1; Lambda Light Chain; MHC II (HLA-DP and DR); Myogenin; MMP-7 (Matrilysin); Topo II beta; CD53; Keratin 19; Radl 8; Ret Oncoprotein; MHC II (HLA-DP); E3-binding protein (ARM1); Progesterone Receptor; Keratin 8; IgG; IgA; Tubulin; Insulin Receptor Substrate-1; Keratin 15; DR3; IL-3; Keratin 10/13; Cyclin D3; MHC I (HLA25 and HLA-Aw32); Calmodulin; Neurofilament (160kDa) |
| Ductal carcinoma in situ (DCIS) v. other Breast cancer | Macrophage; Fibronectin; Granulocyte; Keratin 19; Cyclin D3; CD45/T200/LCA; EGFR; Thrombospondin; CD81/TAPA-1; Ruv C; Plasminogen; Collagen IV; Laminin B1/b1; CD10; TdT; Filamin; bcl-XL; 14.3.3 gamma; 14.3.3, Pan; p170; Apolipoprotein D; CD71/ Transferrin Receptor; FHIT |
| Breast cancer | 5HT2B, 5T4 (trophoblast), ACO2, ACSL3, ACTN4, ADAM10, AGR2, AGR3, ALCAM, ALDH6A1, ANGPTL4, ANO9, AP1G1, APC, APEX1, APLP2, APP (_-amyloid), ARCN1, ARHGAP35, ARL3, ASAH1, ASPH (A-10), ATP1B1, ATP1B3, ATP5I, ATP5O, ATXN1, B7H3, BACE1, BAI3, BAIAP2, BCA-200, BDNF, BigH3, BIRC2, BLVRB, BRCA, BST2, C1GALT1, C1GALT1C1, C20orf3, CA125, CACYBP, Calmodulin, CAPN1, CAPNS1, CCDC64B, CCL2 (MCP-1), CCT3, CD10(BD), CD127 (IL7R), CD174, CD24, CD44, CD80, CD86, CDH1, CDH5, CEA, CFL2, CHCHD3, CHMP3, CHRDL2, CIB1, CKAP4, COPA, COX5B, CRABP2, CRIP1, CRISPLD1, CRMP-2, CRTAP, CTLA4, CUL3, CXCR3, CXCR4, CXCR6, CYB5B, CYB5R1, CYCS, CYFRA 21, DBI, DDX23, DDX39B, derlin 1, DHCR7, DHX9, DLD, DLL4, DNAJB1, DPP6, DSTN, eCadherin, EEF1D, EEF2, EFTUD2, EIF4A2, EIF4A3, EpCaM, EphA2, ER(1) ESR1 _, ER(2) ESR2 _, Erb B4, Erb2, erb3 (Erb-B3?), ERLIN2, ESD, FARSA, FASN, FEN1, FKBP5, FLNB, FOXP3, FUS, Gal3, GCDPF-15, GCNT2, GNA12, GNG5, GNPTG, GPC6, GPD2, GPER (GPR30), GSPT1, H3F3B, H3F3C, HADH, HAP1, HER3, HIST1H1C, HIST1H2AB, HIST1H3A, HIST1H3C, HIST1H3D, HIST1H3E, HIST1H3F, HIST1H3G, HIST1H3H, HIST1H3I, HIST1H3J, HIST2H2BF, HIST2H3A, HIST2H3C, HIST2H3D, HIST3H3, HMGB1, HNRNPA2B1, |

TABLE 4-continued

Illustrative Biomarkers

| Illustrative Class | Biomarkers |
|---|---|
| | HNRNPAB, HNRNPC, HNRNPD, HNRNPH2, HNRNPK, HNRNPL, HNRNPM, HNRNPU, HPS3, HSP-27, HSP70, HSP90B1, HSPA1A, HSPA2, HSPA9, HSPE1, IC3b, IDE, IDH3B, IDO1, IFI30, IL1RL2, IL7, IL8, ILF2, ILF3, IQCG, ISOC2, IST1, ITGA7, ITGB7, junction plakoglobin, Keratin 15, KRAS, KRT19, KRT2, KRT7, KRT8, KRT9, KTN1, LAMP1, LMNA, LMNB1, LNPEP, LRPPRC, LRRC57, Mammaglobin, MAN1A1, MAN1A2, MART1, MATR3, MBD5, MCT2, MDH2, MFGE8, MFGE8, MGP, MMP9, MRP8, MUC1, MUC17, MUC2, MYO5B, MYOF, NAPA, NCAM, NCL, NG2 (CSPG4), Ngal, NHE-3, NME2, NONO, NPM1, NQO1, NT5E (CD73), ODC1, OPG, OPN (SC), OS9, p53, PACSIN3, PAICS, PARK7, PARVA, PC, PCNA, PCSA, PD-1, PD-L1, PD-L2, PGP9.5, PHB, PHB2, PIK3C2B, PKP3, PPL, PR(B)?, PRDX2, PRKCB, PRKCD, PRKDC, PSA, PSAP, PSMA, PSMB7, PSMD2, PSME3, PYCARD, RAB1A, RAB3D, RAB7A, RAGE, RBL2, RNPEP, RPL14, RPL27, RPL36, RPS25, RPS4X, RPS4Y1, RPS4Y2, RUVBL2, SET, SHMT2, SLAIN1, SLC39A14, SLC9A3R2, SMARCA4, SNRPD2, SNRPD3, SNX33, SNX9, SPEN, SPR, SQSTM1, SSBP1, ST3GAL1, STXBP4, SUB1, SUCLG2, Survivin, SYT9, TFF3 (secreted), TGOLN2, THBS1, TIMP1, TIMP2, TMED10, TMED4, TMED9, TMEM211, TOM1, TRAF4 (scaffolding), TRAIL-R2, TRAP1, TrkB, Tsg 101, TXNDC16, U2AF2, UEVLD, UFC1, UNC93a, USP14, VASP, VCP, VDAC1, VEGFA, VEGFR1, VEGFR2, VPS37C, WIZ, XRCC5, XRCC6, YB-1, YWHAZ |
| Lung cancer | Pgrmc1 (progesterone receptor membrane component 1)/sigma-2 receptor, STEAP, EZH2 |
| Lung cancer | Prohibitin, CD23, Amylin Peptide, HRP, Rad51, Pax-5, Oct-3/, GLUT-1, PSCA, Thrombospondin, FHIT, a-B-Crystallin, LewisA, Vacular Endothelial Growth Factor(VEGF), Hepatocyte Factor Homologue-4, Flt-4, GluR6/7, Prostate Apoptosis Response Protein-4, GluR1, Fli-1, Urocortin, S100A4, 14-3-3 beta, P504S, HDAC1, PGP9.5, DJ-1, COX2, MMP-19, Actin, skeletal muscle, Claudin 3, Cadherin-P, Collagen IX, p27Kip1, Cathepsin D, CD30 (Reed-Sternberg Cell Marker), Ubiquitin, FSH-b, TrxR2, CCK-8, Cyclin C, CD138, TGF-beta 2, Adrenocorticotrophic Hormone, PPAR-gamma, Bcl-6, GLUT-3, IGF-I, mRANKL, Fas-ligand, Filamin, Calretinin, O ct-1, Parathyroid Hormone, Claudin 5, Claudin 4, Raf-1 (Phospho-specific), CDC14A Phosphatase, Mitochondria, APC, Gastrin 1, Ku (p80), Gail, XPA, Maltose Binding Protein, Melanoma (gp100), Phosphotyrosine, Amyloid A, CXCR4/Fusin, Hepatic Nuclear Factor-3B, Caspase 1, HPV 16-E7, Axonal Growth Cones, Lck, Ornithine Decarboxylase, Gamma Glutamylcysteine Synthetase(GCS)/Glutamate-cysteine Ligase, ERCC1, Calmodulin, Caspase 7 (Mch 3), CD137 (4-1BB), Nitric Oxide Synthase, brain (bNOS), E2F-2, IL-10R, L-Plastin, CD18, Vimentin, CD50/ICAM-3, Superoxide Dismutase, Adenovirus Type 5 E1A, PHAS-I, Progesterone Receptor (phospho-specific)-Serine 294, MHC II (HLA-DQ), XPG, ER Ca+2 ATPase2, Laminin-s, E3-binding protein (ARM1), CD45RO, CD1, Cdk2, MMP-10 (Stromilysin-2), sm, Surfactant Protein B (Pro), Apolipoprotein D, CD46, Keratin 8 (phospho-specific Ser73), PCNA, PLAP, CD20, Syk, LH, Keratin 19, ADP-ribosylation Factor (ARF-6), Int-2 Oncoprotein, Luciferase, AIF (Apoptosis Inducing Factor), Grb2, bcl-X, CD16, Paxillin, MHC II (HLA-DP and DR), B-Cell, p21WAF1, MHC II (HLA-DR), Tyrosinase, E2F-1, Pds1, Calponin, Notch, CD26/DPP IV, SV40 Large T Antigen, Ku (p70/p80), Perforin, XPF, SIM Ag (SIMA-4D3), Cdk1/p34cdc2, Neuron Specific Enolase, b-2-Microglobulin, DNA Polymerase Beta, Thyroid Hormone Receptor, Human, Alkaline Phosphatase (AP), Plasma Cell Marker, Heat Shock Protein 70/hsp70, TRP75/gp75, SRF (Serum Response Factor), Laminin B1/b1, Mast Cell Chymase, Caldesmon, CEA/CD66e, CD24, Retinoid X Receptor (hRXR), CD45/T200/LCA, Rabies Virus, Cytochrome c, DR3, bcl-XL, Fascin, CD71/Transferrin Receptor |
| Lung Cancer | miR-497 |
| Lung Cancer | Pgrmc1 |
| Ovarian Cancer | CA-125, CA 19-9, c-reactive protein, CD95(also called Fas, Fas antigen, Fas receptor, FasR, TNFRSF6, APT1 or APO-1), FAP-1, miR-200 microRNAs, EGFR, EGFRvIII, apolipoprotein AI, apolipoprotein CIII, myoglobin, tenascin C, MSH6, claudin-3, claudin-4, caveolin-1, coagulation factor III, CD9, CD36, CD37, CD53, CD63, CD81, CD136, CD147, Hsp70, Hsp90, Rab13, Desmocollin-1, EMP-2, CK7, CK20, GCDF15, CD82, Rab-5b, Annexin V, MFG-E8, HLA-DR. MiR-200 microRNAs (miR-200a, miR-200b, miR-200c), miR-141, miR-429, JNK, Jun |
| Prostate Cancer v normal | AQP2, BMP5, C16orf86, CXCL13, DST, ERCC1, GNAO1, KLHL5, MAP4K1, NELL2, PENK, PGF, POU3F1, PRSS21, SCML1, SEMG1, SMARCD3, SNAI2, TAF1C, TNNT3 |
| Prostate Cancer v Breast Cancer | ADRB2, ARG2, C22orf32, CYorf14, EIF1AY, FEV, KLK2, KLK4, LRRC26, MAOA, NLGN4Y, PNPLA7, PVRL3, SIM2, SLC30A4, SLC45A3, STX19, TRIM36, TRPM8 |
| Prostate Cancer v Colorectal Cancer | ADRB2, BAIAP2L2, C19orf33, CDX1, CEACAM6, EEF1A2, ERN2, FAM110B, FOXA2, KLK2, KLK4, LOC389816, LRRC26, MIPOL1, SLC45A3, SPDEF, TRIM31, TRIM36, ZNF613 |
| Prostate Cancer v Lung Cancer | ASTN2, CAB39L, CRIP1, FAM110B, FEV, GSTP1, KLK2, KLK4, LOC389816, LRRC26, MUC1, PNPLA7, SIM2, SLC45A3, SPDEF, TRIM36, TRPV6, ZNF613 |
| Prostate Cancer | miRs-26a+b, miR-15, miR-16, miR-195, miR-497, miR-424, miR-206, miR-342-5p, miR-186, miR-1271, miR-600, miR-216b, miR-519 family, miR-203 |
| Integrins | ITGA1 (CD49a, VLA1), ITGA2 (CD49b, VLA2), ITGA3 (CD49c, VLA3), ITGA4 (CD49d, VLA4), ITGA5 (CD49e, VLA5), ITGA6 (CD49f, VLA6), ITGA7 (FLJ25220), ITGA8, ITGA9 (RLC), ITGA10, ITGA11 (HsT18964), ITGAD (CD11D, FLJ39841), ITGAE (CD103, HUMINAE), ITGAL (CD11a, LFA1A), ITGAM (CD11b, MAC-1), ITGAV |

TABLE 4-continued

Illustrative Biomarkers

| Illustrative Class | Biomarkers |
|---|---|
| | (CD51, VNRA, MSK8), ITGAW, ITGAX (CD11c), ITGB1 (CD29, FNRB, MSK12, MDF20), ITGB2 (CD18, LFA-1, MAC-1, MFI7), ITGB3 (CD61, GP3A, GPIIIa), ITGB4 (CD104), ITGB5 (FLJ26658), ITGB6, ITGB7, ITGB8 |
| Glycoprotein | GpIa-IIa, GpIIb-IIIa, GpIIIb, GpIb, GpIX |
| Transcription factors | STAT3, EZH2, p53, MACC1, SPDEF, RUNX2, YB-1 |
| Kinases | AURKA, AURKB |
| Disease Markers | 6Ckine, Adiponectin, Adrenocorticotropic Hormone, Agouti-Related Protein, Aldose Reductase, Alpha-1-Antichymotrypsin, Alpha-1-Antitrypsin, Alpha-1-Microglobulin, Alpha-2-Macroglobulin, Alpha-Fetoprotein, Amphiregulin, Angiogenin, Angiopoietin-2, Angiotensin-Converting Enzyme, Angiotensinogen, Annexin A1, Apolipoprotein A-I, Apolipoprotein A-II, Apolipoprotein A-IV, Apolipoprotein B, Apolipoprotein C-I, Apolipoprotein C-III, Apolipoprotein D, Apolipoprotein E, Apolipoprotein H, Apolipoprotein(a), AXL Receptor Tyrosine Kinase, B cell-activating Factor, B Lymphocyte Chemoattractant, Bcl-2-like protein 2, Beta-2-Microglobulin, Betacellulin, Bone Morphogenetic Protein 6, Brain-Derived Neurotrophic Factor, Calbindin, Calcitonin, Cancer Antigen 125, Cancer Antigen 15-3, Cancer Antigen 19-9, Cancer Antigen 72-4, Carcinoembryonic Antigen, Cathepsin D, CD 40 antigen, CD40 Ligand, CD5 Antigen-like, Cellular Fibronectin, Chemokine CC-4, Chromogranin-A, Ciliary Neurotrophic Factor, Clusterin, Collagen IV, Complement C3, Complement Factor H, Connective Tissue Growth Factor, Cortisol, C-Peptide, C-Reactive Protein, Creatine Kinase-MB, Cystatin-C, Endoglin, Endostatin, Endothelin-1, EN-RAGE, Eotaxin-1, Eotaxin-2, Eotaxin-3, Epidermal Growth Factor, Epiregulin, Epithelial cell adhesion molecule, Epithelial-Derived Neutrophil-Activating Protein 78, Erythropoietin, E-Selectin, Ezrin, Factor VII, Fas Ligand, FASLG Receptor, Fatty Acid-Binding Protein (adipocyte), Fatty Acid-Binding Protein (heart), Fatty Acid-Binding Protein (liver), Ferritin, Fetuin-A, Fibrinogen, Fibroblast Growth Factor 4, Fibroblast Growth Factor basic, Fibulin-1C, Follicle-Stimulating Hormone, Galectin-3, Gelsolin, Glucagon, Glucagon-like Peptide 1, Glucose-6-phosphate Isomerase, Glutamate-Cysteine Ligase Regulatory subunit, Glutathione S-Transferase alpha, Glutathione 5-Transferase Mu 1, Granulocyte Colony-Stimulating Factor, Granulocyte-Macrophage Colony-Stimulating Factor, Growth Hormone, Growth-Regulated alpha protein, Haptoglobin, HE4, Heat Shock Protein 60, Heparin-Binding EGF-Like Growth Factor, Hepatocyte Growth Factor, Hepatocyte Growth Factor Receptor, Hepsin, Human Chorionic Gonadotropin beta, Human Epidermal Growth Factor Receptor 2, Immunoglobulin A, Immunoglobulin E, Immunoglobulin M, Insulin, Insulin-like Growth Factor I, Insulin-like Growth Factor-Binding Protein 1, Insulin-like Growth Factor-Binding Protein 2, Insulin-like Growth Factor-Binding Protein 3, Insulin-like Growth Factor Binding Protein 4, Insulin-like Growth Factor Binding Protein 5, Insulin-like Growth Factor Binding Protein 6, Intercellular Adhesion Molecule 1, Interferon gamma, Interferon gamma Induced Protein 10, Interferon-inducible T-cell alpha chemoattractant, Interleukin-1 alpha, Interleukin-1 beta, Interleukin-1 Receptor antagonist, Interleukin-2, Interleukin-2 Receptor alpha, Interleukin-3, Interleukin-4, Interleukin-5, Interleukin-6, Interleukin-6 Receptor, Interleukin-6 Receptor subunit beta, Interleukin-7, Interleukin-8, Interleukin-10, Interleukin-11, Interleukin-12 Subunit p40, Interleukin-12 Subunit p70, Interleukin-13, Interleukin-15, Interleukin-16, Interleukin-25, Kallikrein 5, Kallikrein-7, Kidney Injury Molecule-1, Lactoylglutathione lyase, Latency-Associated Peptide of Transforming Growth Factor beta 1, Lectin-Like Oxidized LDL Receptor 1, Leptin, Luteinizing Hormone, Lymphotactin, Macrophage Colony-Stimulating Factor 1, Macrophage Inflammatory Protein-1 alpha, Macrophage Inflammatory Protein-1 beta, Macrophage Inflammatory Protein-3 alpha, Macrophage inflammatory protein 3 beta, Macrophage Migration Inhibitory Factor, Macrophage-Derived Chemokine, Macrophage-Stimulating Protein, Malondialdehyde-Modified Low-Density Lipoprotein, Maspin, Matrix Metalloproteinase-1, Matrix Metalloproteinase-2, Matrix Metalloproteinase-3, Matrix Metalloproteinase-7, Matrix Metalloproteinase-9, Matrix Metalloproteinase-9, Matrix Metalloproteinase-10, Mesothelin, MHC class I chain-related protein A, Monocyte Chemotactic Protein 1, Monocyte Chemotactic Protein 2, Monocyte Chemotactic Protein 3, Monocyte Chemotactic Protein 4, Monokine Induced by Gamma Interferon, Myeloid Progenitor Inhibitory Factor 1, Myeloperoxidase, Myoglobin, Nerve Growth Factor beta, Neuronal Cell Adhesion Molecule, Neuron-Specific Enolase, Neuropilin-1, Neutrophil Gelatinase-Associated Lipocalin, NT-proBNP, Nucleoside diphosphate kinase B, Osteopontin, Osteoprotegerin, Pancreatic Polypeptide, Pepsinogen I, Peptide YY, Peroxiredoxin-4, Phosphoserine Aminotransferase, Placenta Growth Factor, Plasminogen Activator Inhibitor 1, Platelet-Derived Growth Factor BB, Pregnancy-Associated Plasma Protein A, Progesterone, Proinsulin (inc. Total or Intact), Prolactin, Prostasin, Prostate-Specific Antigen (inc. Free PSA), Prostatic Acid Phosphatase, Protein S100-A4, Protein S100-A6, Pulmonary and Activation-Regulated Chemokine, Receptor for advanced glycosylation end products, Receptor tyrosine-protein kinase erbB-3, Resistin, S100 calcium-binding protein B, Secretin, Serotransferrin, Serum Amyloid P-Component, Serum Glutamic Oxaloacetic Transaminase, Sex Hormone-Binding Globulin, Sortilin, Squamous Cell Carcinoma Antigen-1, Stem Cell Factor, Stromal cell-derived Factor-1, Superoxide Dismutase 1 (soluble), T Lymphocyte-Secreted Protein I-309, Tamm-Horsfall Urinary Glycoprotein, T-Cell-Specific Protein RANTES, Tenascin-C, Testosterone, Tetranectin, |

TABLE 4-continued

Illustrative Biomarkers

| Illustrative Class | Biomarkers |
|---|---|
| | Thrombomodulin, Thrombopoietin, Thrombospondin-1, Thyroglobulin, Thyroid-Stimulating Hormone, Thyroxine-Binding Globulin, Tissue Factor, Tissue Inhibitor of Metalloproteinases 1, Tissue type Plasminogen activator, TNF-Related Apoptosis-Inducing Ligand Receptor 3, Transforming Growth Factor alpha, Transforming Growth Factor beta-3, Transthyretin, Trefoil Factor 3, Tumor Necrosis Factor alpha, Tumor Necrosis Factor beta, Tumor Necrosis Factor Receptor I, Tumor necrosis Factor Receptor 2, Tyrosine kinase with Ig and EGF homology domains 2, Urokinase-type Plasminogen Activator, Urokinase-type plasminogen activator Receptor, Vascular Cell Adhesion Molecule-1, Vascular Endothelial Growth Factor, Vascular endothelial growth Factor B, Vascular Endothelial Growth Factor C, Vascular endothelial growth Factor D, Vascular Endothelial Growth Factor Receptor 1, Vascular Endothelial Growth Factor Receptor 2, Vascular endothelial growth Factor Receptor 3, Vitamin K-Dependent Protein S, Vitronectin, von Willebrand Factor, YKL-40 |
| Disease Markers | Adiponectin, Adrenocorticotropic Hormone, Agouti-Related Protein, Alpha-1-Antichymotrypsin, Alpha-1-Antitrypsin, Alpha-1-Microglobulin, Alpha-2-Macroglobulin, Alpha-Fetoprotein, Amphiregulin, Angiopoietin-2, Angiotensin-Converting Enzyme, Angiotensinogen, Apolipoprotein A-I, Apolipoprotein A-II, Apolipoprotein A-IV, Apolipoprotein B, Apolipoprotein C-I, Apolipoprotein C-III, Apolipoprotein D, Apolipoprotein E, Apolipoprotein H, Apolipoprotein(a), AXL Receptor Tyrosine Kinase, B Lymphocyte Chemoattractant, Beta-2-Microglobulin, Betacellulin, Bone Morphogenetic Protein 6, Brain-Derived Neurotrophic Factor, Calbindin, Calcitonin, Cancer Antigen 125, Cancer Antigen 19-9, Carcinoembryonic Antigen, CD 40 antigen, CD40 Ligand, CD5 Antigen-like, Chemokine CC-4, Chromogranin-A, Ciliary Neurotrophic Factor, Clusterin, Complement C3, Complement Factor H, Connective Tissue Growth Factor, Cortisol, C-Peptide, C-Reactive Protein, Creatine Kinase-MB, Cystatin-C, Endothelin-1, EN-RAGE, Eotaxin-1, Eotaxin-3, Epidermal Growth Factor, Epiregulin, Epithelial-Derived Neutrophil-Activating Protein 78, Erythropoietin, E-Selectin, Factor VII, Fas Ligand, FASLG Receptor, Fatty Acid-Binding Protein (heart), Ferritin, Fetuin-A, Fibrinogen, Fibroblast Growth Factor 4, Fibroblast Growth Factor basic, Follicle-Stimulating Hormone, Glucagon, Glucagon-like Peptide 1, Glutathione S-Transferase alpha, Granulocyte Colony-Stimulating Factor, Granulocyte-Macrophage Colony-Stimulating Factor, Growth Hormone, Growth-Regulated alpha protein, Haptoglobin, Heat Shock Protein 60, Heparin-Binding EGF-Like Growth Factor, Hepatocyte Growth Factor, Immunoglobulin A, Immunoglobulin E, Immunoglobulin M, Insulin, Insulin-like Growth Factor I, Insulin-like Growth Factor-Binding Protein 2, Intercellular Adhesion Molecule 1, Interferon gamma, Interferon gamma Induced Protein 10, Interleukin-1 alpha, Interleukin-1 beta, Interleukin-1 Receptor antagonist, Interleukin-2, Interleukin-3, Interleukin-4, Interleukin-5, Interleukin-6, Interleukin-6 Receptor, Interleukin-7, Interleukin-8, Interleukin-10, Interleukin-11, Interleukin-12 Subunit p40, Interleukin-12 Subunit p70, Interleukin-13, Interleukin-15, Interleukin-16, Interleukin-25, Kidney Injury Molecule-1, Lectin-Like Oxidized LDL Receptor 1, Leptin, Luteinizing Hormone, Lymphotactin, Macrophage Colony-Stimulating Factor 1, Macrophage Inflammatory Protein-1 alpha, Macrophage Inflammatory Protein-1 beta, Macrophage Inflammatory Protein-3 alpha, Macrophage Migration Inhibitory Factor, Macrophage-Derived Chemokine, Malondialdehyde-Modified Low-Density Lipoprotein, Matrix Metalloproteinase-1, Matrix Metalloproteinase-2, Matrix Metalloproteinase-3, Matrix Metalloproteinase-7, Matrix Metalloproteinase-9, Matrix Metalloproteinase-9, Matrix Metalloproteinase-10, Monocyte Chemotactic Protein 1, Monocyte Chemotactic Protein 2, Monocyte Chemotactic Protein 3, Monocyte Chemotactic Protein 4, Monokine Induced by Gamma Interferon, Myeloid Progenitor Inhibitory Factor 1, Myeloperoxidase, Myoglobin, Nerve Growth Factor beta, Neuronal Cell Adhesion Molecule, Neutrophil Gelatinase-Associated Lipocalin, NT-proBNP, Osteopontin, Pancreatic Polypeptide, Peptide YY, Placenta Growth Factor, Plasminogen Activator Inhibitor 1, Platelet-Derived Growth Factor BB, Pregnancy-Associated Plasma Protein A, Progesterone, Proinsulin (inc. Intact or Total), Prolactin, Prostate-Specific Antigen (inc. Free PSA), Prostatic Acid Phosphatase, Pulmonary and Activation-Regulated Chemokine, Receptor for advanced glycosylation end products, Resistin, S100 calcium-binding protein B, Secretin, Serotransferrin, Serum Amyloid P-Component, Serum Glutamic Oxaloacetic Transaminase, Sex Hormone-Binding Globulin, Sortilin, Stem Cell Factor, Superoxide Dismutase 1 (soluble), T Lymphocyte-Secreted Protein 1-309, Tamm-Horsfall Urinary Glycoprotein, T-Cell-Specific Protein RANTES, Tenascin-C, Testosterone, Thrombomodulin, Thrombopoietin, Thrombospondin-1, Thyroid-Stimulating Hormone, Thyroxine-Binding Globulin, Tissue Factor, Tissue Inhibitor of Metalloproteinases 1, TNF-Related Apoptosis-Inducing Ligand Receptor 3, Transforming Growth Factor alpha, Transforming Growth Factor beta-3, Transthyretin, Trefoil Factor 3, Tumor Necrosis Factor alpha, Tumor Necrosis Factor beta, Tumor necrosis Factor Receptor 2, Vascular Cell Adhesion Molecule-1, Vascular Endothelial Growth Factor, Vitamin K-Dependent Protein S, Vitronectin, von Willebrand Factor |
| Oncology | 6Ckine, Aldose Reductase, Alpha-Fetoprotein, Amphiregulin, Angiogenin, Annexin A1, B cell-activating Factor, B Lymphocyte Chemoattractant, Bcl-2-like protein 2, Betacellulin, Cancer Antigen 125, Cancer Antigen 15-3, Cancer Antigen 19-9, Cancer Antigen 72-4, Carcinoembryonic Antigen, Cathepsin D, Cellular Fibronectin, Collagen IV, Endoglin, Endostatin, Eotaxin-2, Epidermal Growth Factor, Epiregulin, Epithelial cell adhesion molecule, Ezrin, Fatty Acid-Binding Protein (adipocyte), Fatty Acid-Binding Protein (liver), Fibroblast Growth Factor basic, Fibulin-1C, Galectin-3, Gelsolin, Glucose-6-phosphate |

TABLE 4-continued

Illustrative Biomarkers

| Illustrative Class | Biomarkers |
|---|---|
|  | Isomerase, Glutamate-Cysteine Ligase Regulatory subunit, Glutathione S-Transferase Mu 1, HE4, Heparin-Binding EGF-Like Growth Factor, Hepatocyte Growth Factor, Hepatocyte Growth Factor Receptor, Hepsin, Human Chorionic Gonadotropin beta, Human Epidermal Growth Factor Receptor 2, Insulin-like Growth Factor-Binding Protein 1, Insulin-like Growth Factor-Binding Protein 2, Insulin-like Growth Factor-Binding Protein 3, Insulin-like Growth Factor Binding Protein 4, Insulin-like Growth Factor Binding Protein 5, Insulin-like Growth Factor Binding Protein 6, Interferon gamma Induced Protein 10, Interferon-inducible T-cell alpha chemoattractant, Interleukin-2 Receptor alpha, Interleukin-6, Interleukin-6 Receptor subunit beta, Kallikrein 5, Kallikrein-7, Lactoylglutathione lyase, Latency-Associated Peptide of Transforming Growth Factor beta 1, Leptin, Macrophage inflammatory protein 3 beta, Macrophage Migration Inhibitory Factor, Macrophage-Stimulating Protein, Maspin, Matrix Metalloproteinase-2, Mesothelin, MHC class I chain-related protein A, Monocyte Chemotactic Protein 1, Monokine Induced by Gamma Interferon, Neuron-Specific Enolase, Neuropilin-1, Neutrophil Gelatinase-Associated Lipocalin, Nucleoside diphosphate kinase B, Osteopontin, Osteoprotegerin, Pepsinogen I, Peroxiredoxin-4, Phosphoserine Aminotransferase, Placenta Growth Factor, Platelet-Derived Growth Factor BB, Prostasin, Protein S100-A4, Protein S100-A6, Receptor tyrosine-protein kinase erbB-3, Squamous Cell Carcinoma Antigen-1, Stromal cell-derived Factor-1, Tenascin-C, Tetranectin, Thyroglobulin, Tissue type Plasminogen activator, Transforming Growth Factor alpha, Tumor Necrosis Factor Receptor I, Tyrosine kinase with Ig and EGF homology domains 2, Urokinase-type Plasminogen Activator, Urokinase-type plasminogen activator Receptor, Vascular Endothelial Growth Factor, Vascular endothelial growth Factor B, Vascular Endothelial Growth Factor C, Vascular endothelial growth Factor D, Vascular Endothelial Growth Factor Receptor 1, Vascular Endothelial Growth Factor Receptor 2, Vascular endothelial growth Factor Receptor 3, YKL-40 |
| Disease | Adiponectin, Alpha-1-Antitrypsin, Alpha-2-Macroglobulin, Alpha-Fetoprotein, Apolipoprotein A-I, Apolipoprotein C-III, Apolipoprotein H, Apolipoprotein(a), Beta-2-Microglobulin, Brain-Derived Neurotrophic Factor, Calcitonin, Cancer Antigen 125, Cancer Antigen 19-9, Carcinoembryonic Antigen, CD 40 antigen, CD40 Ligand, Complement C3, C-Reactive Protein, Creatine Kinase-MB, Endothelin-1, EN-RAGE, Eotaxin-1, Epidermal Growth Factor, Epithelial-Derived Neutrophil-Activating Protein 78, Erythropoietin, Factor VII, Fatty Acid-Binding Protein (heart), Ferritin, Fibrinogen, Fibroblast Growth Factor basic, Granulocyte Colony-Stimulating Factor, Granulocyte-Macrophage Colony-Stimulating Factor, Growth Hormone, Haptoglobin, Immunoglobulin A, Immunoglobulin E, Immunoglobulin M, Insulin, Insulin-like Growth Factor I, Intercellular Adhesion Molecule 1, Interferon gamma, Interleukin-1 alpha, Interleukin-1 beta, Interleukin-1 Receptor antagonist, Interleukin-2, Interleukin-3, Interleukin-4, Interleukin-5, Interleukin-6, Interleukin-7, Interleukin-8, Interleukin-10, Interleukin-12 Subunit p40, Interleukin-12 Subunit p70, Interleukin-13, Interleukin-15, Interleukin-16, Leptin, Lymphotactin, Macrophage Inflammatory Protein-1 alpha, Macrophage Inflammatory Protein-1 beta, Macrophage-Derived Chemokine, Matrix Metalloproteinase-2, Matrix Metalloproteinase-3, Matrix Metalloproteinase-9, Monocyte Chemotactic Protein 1, Myeloperoxidase, Myoglobin, Plasminogen Activator Inhibitor 1, Pregnancy-Associated Plasma Protein A, Prostate-Specific Antigen (inc. Free PSA), Prostatic Acid Phosphatase, Serum Amyloid P-Component, Serum Glutamic Oxaloacetic Transaminase, Sex Hormone-Binding Globulin, Stem Cell Factor, T-Cell-Specific Protein RANTES, Thrombopoietin, Thyroid-Stimulating Hormone, Thyroxine-Binding Globulin, Tissue Factor, Tissue Inhibitor of Metalloproteinases 1, Tumor Necrosis Factor alpha, Tumor Necrosis Factor beta, Tumor Necrosis Factor Receptor 2, Vascular Cell Adhesion Molecule-1, Vascular Endothelial Growth Factor, von Willebrand Factor |
| Neurological | Alpha-1-Antitrypsin, Apolipoprotein A-I, Apolipoprotein A-II, Apolipoprotein B, Apolipoprotein C-I, Apolipoprotein H, Beta-2-Microglobulin, Betacellulin, Brain-Derived Neurotrophic Factor, Calbindin, Cancer Antigen 125, Carcinoembryonic Antigen, CD5 Antigen-like, Complement C3, Connective Tissue Growth Factor, Cortisol, Endothelin-1, Epidermal Growth Factor Receptor, Ferritin, Fetuin-A, Follicle-Stimulating Hormone, Haptoglobin, Immunoglobulin A, Immunoglobulin M, Intercellular Adhesion Molecule 1, Interleukin-6 Receptor, Interleukin-7, Interleukin-10, Interleukin-11, Interleukin-17, Kidney Injury Molecule-1, Luteinizing Hormone, Macrophage-Derived Chemokine, Macrophage Migration Inhibitory Factor, Macrophage Inflammatory Protein-1 alpha, Matrix Metalloproteinase-2, Monocyte Chemotactic Protein 2, Peptide YY, Prolactin, Prostatic Acid Phosphatase, Serotransferrin, Serum Amyloid P-Component, Sortilin, Testosterone, Thrombopoietin, Thyroid-Stimulating Hormone, Tissue Inhibitor of Metalloproteinases 1, TNF-Related Apoptosis-Inducing Ligand Receptor 3, Tumor necrosis Factor Receptor 2, Vascular Endothelial Growth Factor, Vitronectin |
| Cardiovascular | Adiponectin, Apolipoprotein A-I, Apolipoprotein B, Apolipoprotein C-III, Apolipoprotein D, Apolipoprotein E, Apolipoprotein H, Apolipoprotein(a), Clusterin, C-Reactive Protein, Cystatin-C, EN-RAGE, E-Selectin, Fatty Acid-Binding Protein (heart), Ferritin, Fibrinogen, Haptoglobin, Immunoglobulin M, Intercellular Adhesion Molecule 1, Interleukin-6, Interleukin-8, Lectin-Like Oxidized LDL Receptor 1, Leptin, Macrophage Inflammatory Protein-1 alpha, Macrophage Inflammatory Protein-1 beta, Malondialdehyde-Modified Low-Density Lipoprotein, Matrix Metalloproteinase-1, Matrix Metalloproteinase-10, Matrix |

TABLE 4-continued

Illustrative Biomarkers

| Illustrative Class | Biomarkers |
|---|---|
| | Metalloproteinase-2, Matrix Metalloproteinase-3, Matrix Metalloproteinase-7, Matrix Metalloproteinase-9, Monocyte Chemotactic Protein 1, Myeloperoxidase, Myoglobin, NT-proBNP, Osteopontin, Plasminogen Activator Inhibitor 1, P-Selectin, Receptor for advanced glycosylation end products, Serum Amyloid P-Component, Sex Hormone-Binding Globulin, T-Cell-Specific Protein RANTES, Thrombomodulin, Thyroxine-Binding Globulin, Tissue Inhibitor of Metalloproteinases 1, Tumor Necrosis Factor alpha, Tumor necrosis Factor Receptor 2, Vascular Cell Adhesion Molecule-1, von Willebrand Factor |
| Inflammatory | Alpha-1-Antitrypsin, Alpha-2-Macroglobulin, Beta-2-Microglobulin, Brain-Derived Neurotrophic Factor, Complement C3, C-Reactive Protein, Eotaxin-1, Factor VII, Ferritin, Fibrinogen, Granulocyte-Macrophage Colony-Stimulating Factor, Haptoglobin, Intercellular Adhesion Molecule 1, Interferon gamma, Interleukin-1 alpha, Interleukin-1 beta, Interleukin-1 Receptor antagonist, Interleukin-2, Interleukin-3, Interleukin-4, Interleukin-5, Interleukin-6, Interleukin-7, Interleukin-8, Interleukin-10, Interleukin-12 Subunit p40, Interleukin-12 Subunit p70, Interleukin-15, Interleukin-17, Interleukin-23, Macrophage Inflammatory Protein-1 alpha, Macrophage Inflammatory Protein-1 beta, Matrix Metalloproteinase-2, Matrix Metalloproteinase-3, Matrix Metalloproteinase-9, Monocyte Chemotactic Protein 1, Stem Cell Factor, T-Cell-Specific Protein RANTES, Tissue Inhibitor of Metalloproteinases 1, Tumor Necrosis Factor alpha, Tumor Necrosis Factor beta, Tumor necrosis Factor Receptor 2, Vascular Cell Adhesion Molecule-1, Vascular Endothelial Growth Factor, Vitamin D-Binding Protein, von Willebrand Factor |
| Metabolic | Adiponectin, Adrenocorticotropic Hormone, Angiotensin-Converting Enzyme, Angiotensinogen, Complement C3 alpha des arg, Cortisol, Follicle-Stimulating Hormone, Galanin, Glucagon, Glucagon-like Peptide 1, Insulin, Insulin-like Growth Factor I, Leptin, Luteinizing Hormone, Pancreatic Polypeptide, Peptide YY, Progesterone, Prolactin, Resistin, Secretin, Testosterone |
| Kidney | Alpha-1-Microglobulin, Beta-2-Microglobulin, Calbindin, Clusterin, Connective Tissue Growth Factor, Creatinine, Cystatin-C, Glutathione S-Transferase alpha, Kidney Injury Molecule-1, Microalbumin, Neutrophil Gelatinase-Associated Lipocalin, Osteopontin, Tamm-Horsfall Urinary Glycoprotein, Tissue Inhibitor of Metalloproteinases 1, Trefoil Factor 3, Vascular Endothelial Growth Factor |
| Cytokines | Granulocyte-Macrophage Colony-Stimulating Factor, Interferon gamma, Interleukin-2, Interleukin-3, Interleukin-4, Interleukin-5, Interleukin-6, Interleukin-7, Interleukin-8, Interleukin-10, Macrophage Inflammatory Protein-1 alpha, Macrophage Inflammatory Protein-1 beta, Matrix Metalloproteinase-2, Monocyte Chemotactic Protein 1, Tumor Necrosis Factor alpha, Tumor Necrosis Factor beta, Brain-Derived Neurotrophic Factor, Eotaxin-1, Intercellular Adhesion Molecule 1, Interleukin-1 alpha, Interleukin-1 beta, Interleukin-1 Receptor antagonist, Interleukin-12 Subunit p40, Interleukin-12 Subunit p70, Interleukin-15, Interleukin-17, Interleukin-23, Matrix Metalloproteinase-3, Stem Cell Factor, Vascular Endothelial Growth Factor |
| Protein | 14.3.3 gamma, 14.3.3 (Pan), 14-3-3 beta, 6-Histidine, a-B-Crystallin, Acinus, Actin beta, Actin (Muscle Specific), Actin (Pan), Actin (skeletal muscle), Activin Receptor Type II, Adenovirus, Adenovirus Fiber, Adenovirus Type 2 EIA, Adenovirus Type 5 EIA, ADP-ribosylation Factor (ARF-6), Adrenocorticotrophic Hormone, AIF (Apoptosis Inducing Factor), Alkaline Phosphatase (AP), Alpha Fetoprotein (AFP), Alpha Lactalbumin, alpha-1-antichymotrypsin, alpha-1-antitrypsin, Amphiregulin, Amylin Peptide, Amyloid A, Amyloid A4 Protein Precursor, Amyloid Beta (APP), Androgen Receptor, Ang-1, Ang-2, APC, APC11, APC2, Apolipoprotein D, A-Raf, ARC, Ask1/MAPKKK5, ATM, Axonal Growth Cones, b Galactosidase, b-2-Microglobulin, B7-H2, BAG-1, Bak, Bax, B-Cell, B-cell Linker Protein (BLNK), BcL10/CIPER/CLAP/mE10, bcl-2a, Bcl-6, bcl-X, bcl-XL, Bim (BOD), Biotin, Bonzo/STRL33/TYMSTR, Bovine Serum Albumin, BRCA2 (aa 1323-1346), BrdU, Bromodeoxyuridine (BrdU), CA125, CA19-9, c-Abl, Cadherin (Pan), Cadherin-E, Cadherin-P, Calcitonin, Calcium Pump ATPase, Caldesmon, Calmodulin, Calponin, Calretinin, Casein, Caspase 1, Caspase 2, Caspase 3, Caspase 5, Caspase 6 (Mch 2), Caspase 7 (Mch 3), Caspase 8 (FLICE), Caspase 9, Catenin alpha, Catenin beta, Catenin gamma, Cathepsin D, CCK-8, CD1, CD10, CD100/Leukocyte Semaphorin, CD105, CD106/VCAM, CD115/c-fms/CSF-1R/M-CSFR, CD137 (4-1BB), CD138, CD14, CD15, CD155/PVR (Polio Virus Receptor), CD16, CD165, CD18, CD1a, CD1b, CD2, CD20, CD21, CD23, CD231, CD24, CD25/IL-2 Receptor a, CD26/DPP IV, CD29, CD30 (Reed-Sternberg Cell Marker), CD32/Fcg Receptor II, CD35/CR1, CD36GPIIIb/GPIV, CD3zeta, CD4, CD40, CD42b, CD43, CD45/T200/LCA, CD45RB, CD45RO, CD46, CD5, CD50/ICAM-3, CD53, CD54/ICAM-1, CD56/NCAM-1, CD57, CD59/MACIF/MIRL/Protectin, CD6, CD61/Platelet Glycoprotein IIIA, CD63, CD68, CD71/Transferrin Receptor, CD79a mb-1, CD79b, CD8, CD81/TAPA-1, CD84, CD9, CD94, CD95/Fas, CD98, CDC14A Phosphatase, CDC25C, CDC34, CDC37, CDC47, CDC6, cdh1, Cdk1/p34cdc2, Cdk2, Cdk3, Cdk4, Cdk5, Cdk7, Cdk8, CDw17, CDw60, CDw75, CDw78, CEA/CD66e, c-erbB-2/HER-2/neu Ab-1 (21N), c-erbB-4/HER-4, c-fos, Chk1, Chorionic Gonadotropin beta (hCG-beta), Chromogranin A, CIDE-A, CIDE-B, CITED, c-jun, Clathrin, claudin 11, Claudin 2, Claudin 3, Claudin 4, Claudin 5, CLAUDIN 7, Claudin-1, CNPase, Collagen II, Collagen IV, Collagen IX, Collagen VII, Connexin 43, COX2, CREB, CREB-Binding Protein, *Cryptococcus neoformans*, c-Src, Cullin-1 (CUL-1), Cullin-2 (CUL-2), Cullin-3 (CUL-3), CXCR4/Fusin, Cyclin B1, Cyclin C, Cyclin D1, Cyclin D3, Cyclin E, Cyclin E2, Cystic Fibrosis Transmembrane Regulator, Cytochrome c, D4-GDI, Daxx, DcR1, DcR2/TRAIL- |

TABLE 4-continued

Illustrative Biomarkers

| Illustrative Class | Biomarkers |
|---|---|
| | R4/TRUNDD, Desmin, DFF40 (DNA Fragmentation Factor 40)/CAD, DFF45/ICAD, DJ-1, DNA Ligase I, DNA Polymerase Beta, DNA Polymerase Gamma, DNA Primase (p49), DNA Primase (p58), DNA-PKcs, DP-2, DR3, DRS, Dysferlin, Dystrophin, E2F-1, E2F-2, E2F-3, E2F-4, E2F-5, E3-binding protein (ARM1), EGFR, EMA/CA15-3/MUC-1, Endostatin, Epithelial Membrane Antigen (EMA/CA15-3/MUC-1), Epithelial Specific Antigen, ER beta, ER Ca+2 ATPase2, ERCC1, Erk1, ERK2, Estradiol, Estriol, Estrogen Receptor, Exo1, Ezrin/p81/80K/Cytovillin, F.VIII/VWF, Factor VIII Related Antigen, FADD (FAS-Associated death domain-containing protein), Fascin, Fas-ligand, Ferritin, FGF-1, FGF-2, FHIT, Fibrillin-1, Fibronectin, Filaggrin, Filamin, FITC, Fli-1, FLIP, Flk-1/KDR/VEGFR2, Flt-1/VEGFR1, Flt-4, Fra2, FSH, FSH-b, Fyn, Ga0, Gab-1, GABA a Receptor 1, GAD65, Gail, Gamma Glutamyl Transferase (gGT), Gamma Glutamylcysteine Synthetase(GCS)/Glutamate-cysteine Ligase, GAPDH, Gastrin 1, GCDFP-15, G-CSF, GFAP, Glicentin, Glucagon, Glucose-Regulated Protein 94, GluR 2/3, GluR1, GluR4, GluR6/7, GLUT-1, GLUT-3, Glycogen Synthase Kinase 3b (GSK3b), Glycophorin A, GM-CSF, GnRH Receptor, Golgi Complex, Granulocyte, Granzyme B, Grb2, Green Fluorescent Protein (GFP), GRIP1, Growth Hormone (hGH), GSK-3, GST, GSTmu, *H. Pylori*, HDAC1, HDJ-2/DNAJ, Heat Shock Factor 1, Heat Shock Factor 2, Heat Shock Protein 27/hsp27, Heat Shock Protein 60/hsp60, Heat Shock Protein 70/hsp70, Heat Shock Protein 75/hsp75, Heat Shock Protein 90a/hsp86, Heat Shock Protein 90b/hsp84, *Helicobacter pylori*, Heparan Sulfate Proteoglycan, Hepatic Nuclear Factor-3B, Hepatocyte, Hepatocyte Factor Homologue-4, Hepatocyte Growth Factor, Heregulin, HIF-1a, Histone H1, hPL, HPV 16, HPV 16-E7, HRP, Human Sodium Iodide Symporter (hNIS), I-FLICE/CASPER, IFN gamma, IgA, IGF-1R, IGF-I, IgG, IgM (m-Heavy Chain), I-Kappa-B Kinase b (IKKb), IL-1 alpha, IL-1 beta, IL-10, IL-10R, IL17, IL-2, IL-3, IL-30, IL-4, IL-5, IL-6, IL-8, Inhibin alpha, Insulin, Insulin Receptor, Insulin Receptor Substrate-1, Int-2 Oncoprotein, Integrin beta5, Interferon-a(II), Interferon-g, Involucrin, IP10/CRG2, IPO-38 Proliferation Marker, IRAK, ITK, JNK Activating kinase (JKK1), Kappa Light Chain, Keratin 10, Keratin 10/13, Keratin 14, Keratin 15, Keratin 16, Keratin 18, Keratin 19, Keratin 20, Keratin 5/6/18, Keratin 5/8, Keratin 8, Keratin 8 (phospho-specific Ser73), Keratin 8/18, Keratin (LMW), Keratin (Multi), Keratin (Pan), Ki67, Ku (p70/p80), Ku (p80), L1 Cell Adhesion Molecule, Lambda Light Chain, Laminin B1/b1, Laminin B2/g1, Laminin Receptor, Laminin-s, Lck, Lck (p56lck), Leukotriene (C4, D4, E4), LewisA, LewisB, LH, L-Plastin, LRP/MVP, Luciferase, Macrophage, MADD, MAGE-1, Maltose Binding Protein, MAP1B, MAP2a,b, MART-1/Melan-A, Mast Cell Chymase, Mcl-1, MCM2, MCMS, MDM2, Medroxyprogesterone Acetate (MPA), Mek1, Mek2, Mek6, Mekk-1, Melanoma (gp100), mGluR1, mGluR5, MGMT, MHC I (HLA25 and HLA-Aw32), MHC I (HLA-A), MHC I (HLA-A,B,C), MHC I (HLA-B), MHC II (HLA-DP and DR), MHC II (HLA-DP), MHC II (HLA-DQ), MHC II (HLA-DR), MHC II (HLA-DR) Ia, Microphthalmia, Milk Fat Globule Membrane Protein, Mitochondria, MLH1, MMP-1 (Collagenase-I), MMP-10 (Stromilysin-2), MMP-11 (Stromelysin-3), MMP-13 (Collagenase-3), MMP-14/MT1-MMP, MMP-15/MT2-MMP, MMP-16/MT3-MMP, MMP-19, MMP-2 (72 kDa Collagenase IV), MMP-23, MMP-7 (Matrilysin), MMP-9 (92 kDa Collagenase IV), Moesin, mRANKL, Muc-1, Mucin 2, Mucin 3 (MUC3), Mucin SAC, MyD88, Myelin/Oligodendrocyte, Myeloid Specific Marker, Myeloperoxidase, MyoD1, Myogenin, Myoglobin, Myosin Smooth Muscle Heavy Chain, Nck, Negative Control for Mouse IgG1, Negative Control for Mouse IgG2a, Negative Control for Mouse IgG3, Negative Control for Mouse IgM, Negative Control for Rabbit IgG, Neurofilament, Neurofilament (160 kDa), Neurofilament (200 kDa), Neurofilament (68 kDa), Neuron Specific Enolase, Neutrophil Elastase, NF kappa B/p50, NF kappa B/p65 (Rel A), NGF-Receptor (p75NGFR), brain Nitric Oxide Synthase (bNOS), endothelial Nitric Oxide Synthase (eNOS), nm23, NOS-i, NOS-u, Notch, Nucleophosmin (NPM), NuMA, O ct-1, Oct-2/, Oct-3/, Ornithine Decarboxylase, Osteopontin, p130, p130cas, p14ARF, p15INK4b, p16INK4a, p170, p170/MDR-1, p18INK4c, p19ARF, p19Skp1, p21WAF1, p27Kip1, p300/CBP, p35nck5a, P504S, p53, p57Kip2 Ab-7, p63 (p53 Family Member), p73, p73a, p73a/b, p95VAV, Parathyroid Hormone, Parathyroid Hormone Receptor Type 1, Parkin, PARP, PARP (Poly ADP-Ribose Polymerase), Pax-5, Paxillin, PCNA, PCTAIRE2, PDGF, PDGFR alpha, PDGFR beta, Pds1, Perforin, PGP9.5, PHAS-I, PHAS-II, Phospho-Ser/Thr/Tyr, Phosphotyrosine, PLAP, Plasma Cell Marker, Plasminogen, PLC gamma 1, PMP-22, *Pneumocystis jiroveci*, PPAR-gamma, PR3 (Proteinase 3), Presenillin, Progesterone, Progesterone Receptor, Progesterone Receptor (phospho-specific)-Serine 190, Progesterone Receptor (phospho-specific)-Serine 294, Prohibitin, Prolactin, Prolactin Receptor, Prostate Apoptosis Response Protein-4, Prostate Specific Acid Phosphatase, Prostate Specific Antigen, pS2, PSCA, Rabies Virus, RAD1, Rad51, Raf1, Raf-1 (Phospho-specific), RAIDD, Ras, Rad18, Renal Cell Carcinoma, Ret Oncoprotein, Retinoblastoma, Retinoblastoma (Rb) (Phospho-specific Serine608), Retinoic Acid Receptor (b), Retinoid X Receptor (hRXR), Retinol Binding Protein, Rhodopsin (Opsin), ROC, RPA/p32, RPA/p70, Ruv A, Ruv B, Ruv C, S100, S100A4, S100A6, SHP-1, SIM Ag (SIMA-4D3), SIRP a1, sm, SODD (Silencer of Death Domain), Somatostatin Receptor-I, SRC1 (Steroid Receptor Coactivator-1) Ab-1, SREBP-1 (Sterol Regulatory Element Binding Protein-1), SRF (Serum Response Factor), Stat-1, Stat3, StatS, Stat5a, Stat5b, Stat6, Streptavidin, Superoxide Dismutase, Surfactant |

TABLE 4-continued

Illustrative Biomarkers

| Illustrative Class | Biomarkers |
|---|---|
| | Protein A, Surfactant Protein B, Surfactant Protein B (Pro), Survivin, SV40 Large T Antigen, Syk, Synaptophysin, Synuclein, Synuclein beta, Synuclein pan, TACE (TNF-alpha converting enzyme)/ADAM17, TAG-72, tau, TdT, Tenascin, Testosterone, TGF beta 3, TGF-beta 2, Thomsen-Friedenreich Antigen, Thrombospondin, Thymidine Phosphorylase, Thymidylate Synthase, Thymine Glycols, Thyroglobulin, Thyroid Hormone Receptor beta, Thyroid Hormone Receptor, Thyroid Stimulating Hormone (TSH), TID-1, TIMP-1, TIMP-2, TNF alpha, TNFa, TNR-R2, Topo II beta, Topoisomerase IIa, *Toxoplasma Gondii*, TR2, TRADD, Transforming Growth Factor a, Transglutaminase II, TRAP, Tropomyosin, TRP75/gp75, TrxR2, TTF-1, Tubulin, Tubulin-a, Tubulin-b, Tyrosinase, Ubiquitin, UCP3, uPA, Urocortin, Vacular Endothelial Growth Factor(VEGF), Vimentin, Vinculin, Vitamin D Receptor (VDR), von Hippel-Lindau Protein, Wnt-1, Xanthine Oxidase, XPA, XPF, XPG, XRCC1, XRCC2, ZAP-70, Zip kinase |
| Known Cancer Genes | ABL1, ABL2, ACSL3, AF15Q14, AF1Q, AF3p21, AF5q31, AKAP9, AKT1, AKT2, ALDH2, ALK, ALO17, APC, ARHGEF12, ARHH, ARID1A, ARID2, ARNT, ASPSCR1, ASXL1, ATF1, ATIC, ATM, ATRX, BAP1, BCL10, BCL11A, BCL11B, BCL2, BCL3, BCL5, BCL6, BCL7A, BCL9, BCOR, BCR, BHD, BIRC3, BLM, BMPR1A, BRAF, BRCA1, BRCA2, BRD3, BRD4, BRIP1, BTG1, BUB1B, C12orf9, C15orf21, C15orf55, C16orf75, CANT1, CARD11, CARS, CBFA2T1, CBFA2T3, CBFB, CBL, CBLB, CBLC, CCNB1IP1, CCND1, CCND2, CCND3, CCNE1, CD273, CD274, CD74, CD79A, CD79B, CDH1, CDH11, CDK12, CDK4, CDK6, CDKN2A, CDKN2a(p14), CDKN2C, CDX2, CEBPA, CEP1, CHCHD7, CHEK2, CHIC2, CHN1, CIC, CIITA, CLTC, CLTCL1, CMKOR1, COL1A1, COPEB, COX6C, CREB1, CREB3L1, CREB3L2, CREBBP, CRLF2, CRTC3, CTNNB1, CYLD, D10S170, DAXX, DDB2, DDIT3, DDX10, DDXS, DDX6, DEK, DICER1, DNMT3A, DUX4, EBF1, EGFR, EIF4A2, ELF4, ELK4, ELKS, ELL, ELN, EML4, EP300, EPS15, ERBB2, ERCC2, ERCC3, ERCC4, ERCC5, ERG, ETV1, ETV4, ETV5, ETV6, EVI1, EWSR1, EXT1, EXT2, EZH2, FACL6, FAM22A, FAM22B, FAM46C, FANCA, FANCC, FANCD2, FANCE, FANCF, FANCG, FBXO11, FBXW7, FCGR2B, FEV, FGFR1, FGFR1OP, FGFR2, FGFR3, FH, FHIT, FIP1L1, FLI1, F1127352, FLT3, FNBP1, FOXL2, FOXO1A, FOXO3A, FOXP1, FSTL3, FUBP1, FUS, FVT1, GAS7, GATA1, GATA2, GATA3, GMPS, GNA11, GNAQ, GNAS, GOLGA5, GOPC, GPC3, GPHN, GRAF, HCMOGT-1, HEAB, HERPUD1, HEY1, HIP1, HIST1H4I, HLF, HLXB9, HMGA1, HMGA2, HNRNPA2B1, HOOK3, HOXA11, HOXA13, HOXA9, HOXC11, HOXC13, HOXD11, HOXD13, HRAS, HRPT2, HSPCA, HSPCB, IDH1, IDH2, IGH@, IGK@, IGL@, IKZF1, IL2, IL21R, IL6ST, IL7R, IRF4, IRTA1, ITK, JAK1, JAK2, JAK3, JAZF1, JUN, KDM5A, KDM5C, KDM6A, KDR, KIAA1549, KIT, KLK2, KRAS, KTN1, LAF4, LASP1, LCK, LCP1, LCX, LHFP, LIFR, LMO1, LMO2, LPP, LYL1, MADH4, MAF, MAFB, MALT1, MAML2, MAP2K4, MDM2, MDM4, MDS1, MDS2, MECT1, MED12, MEN1, MET, MITF, MKL1, MLF1, MLH1, MLL, MLL2, MLL3, MLLT1, MLLT10, MLLT2, MLLT3, MLLT4, MLLT6, MLLT7, MN1, MPL, MSF, MSH2, MSH6, MSI2, MSN, MTCP1, MUC1, MUTYH, MYB, MYC, MYCL1, MYCN, MYD88, MYH11, MYH9, MYST4, NACA, NBS1, NCOA1, NCOA2, NCOA4, NDRG1, NF1, NF2, NFE2L2, NFIB, NFKB2, NIN, NKX2-1, NONO, NOTCH1, NOTCH2, NPM1, NR4A3, NRAS, NSD1, NTRK1, NTRK3, NUMA1, NUP214, NUP98, OLIG2, OMD, P2RY8, PAFAH1B2, PALB2, PAX3, PAX5, PAX7, PAX8, PBRM1, PBX1, PCM1, PCSK7, PDE4DIP, PDGFB, PDGFRA, PDGFRB, PER1, PHOX2B, PICALM, PIK3CA, PIK3R1, PIM1, PLAG1, PML, PMS1, PMS2, PMX1, PNUTL1, POU2AF1, POU5F1, PPARG, PPP2R1A, PRCC, PRDM1, PRDM16, PRF1, PRKAR1A, PRO1073, PSIP2, PTCH, PTEN, PTPN11, RAB5EP, RAD51L1, RAF1, RALGDS, RANBP17, RAP1GDS1, RARA, RBI, RBM15, RECQL4, REL, RET, ROS1, RPL22, RPN1, RUNDC2A, RUNX1, RUNXBP2, SBDS, SDHS, SDHB, SDHC, SDHD, SEPT6, SET, SETD2, SF3B1, SFPQ, SFRS3, SH3GL1, SIL, SLC45A3, SMARCA4, SMARCB1, SMO, SOCS1, SOX2, SRGAP3, SRSF2, SS18, SS18L1, SSH3BP1, SSX1, SSX2, SSX4, STK11, STL, SUFU, SUZ12, SYK, TAF15, TAL1, TAL2, TCEA1, TCF1, TCF12, TCF3, TCF7L2, TCL1A, TCL6, TET2, TFE3, TFEB, TFG, TFPT, TFRC, THRAP3, TIF1, TLX1, TLX3, TMPRSS2, TNFAIP3, TNFRSF14, TNFRSF17, TNFRSF6, TOP1, TP53, TPM3, TPM4, TPR, TRA@, TRB@, TRD@, TRIM27, TRIM33, TRIP11, TSC1, TSC2, TSHR, TTL, U2AF1, USP6, VHL, VTI1A, WAS, WHSC1, WHSC1L1, WIF1, WRN, WT1, WTX, XPA, XPC, XPO1, YWHAE, ZNF145, ZNF198, ZNF278, ZNF331, ZNF384, ZNF521, ZNF9, ZRSR2 |
| Known Cancer Genes | AR, androgen receptor; ARPC1A, actin-related protein complex 2/3 subunit A; AURKA, Aurora kinase A; BAG4, Bcl-2 associated anthogene 4; Bcl2l2, Bcl-2 like 2; BIRC2, Baculovirus IAP repeat containing protein 2; CACNA1E, calcium channel voltage dependent alpha-1E subunit; CCNE1, cyclin E1; CDK4, cyclin dependent kinase 4; CHD1L, chromodomain helicase DNA binding domain 1-like; CKS1B, CDC28 protein kinase 1B; COPS3, COP9 subunit 3; DCUN1D1, DCN1 domain containing protein 1; DYRK2, dual specificity tyrosine phosphorylation regulated kinase 2; EEF1A2, eukaryotic elongation transcription factor 1 alpha 2; EGFR, epidermal growth factor receptor; FADD, Fas-associated via death domain; FGFR1, fibroblast growth factor receptor 1; GATA6, GATA binding protein 6; GPCS, glypican 5; GRB7, growth factor receptor bound protein 7; MAP3K5, mitogen activated protein kinase kinase kinase 5; MED29, mediator complex subunit 5; MITF, microphthalmia associated transcription factor; MTDH, metadherin; NCOA3, nuclear receptor coactivator 3; NKX2-1, NK2 homeobox 1; PAK1, p21/CDC42/RAC1-activated kinase 1; PAX9, paired box gene 9; PIK3CA, |

TABLE 4-continued

Illustrative Biomarkers

| Illustrative Class | Biomarkers |
|---|---|
| | phosphatidylinositol-3 kinase catalytic a; PLA2G10, phopholipase A2, group X; PPM1D, protein phosphatase magnesium-dependent 1D; PTK6, protein tyrosine kinase 6; PRKCI, protein kinase C iota; RPS6KB1, ribosomal protein s6 kinase 70 kDa; SKP2, s-phase kinase associated protein; SMURF1, sMAD specific E3 ubiquitin protein ligase 1; SHH, sonic hedgehog homologue; STARD3, sTAR-related lipid transfer domain containing protein 3; YWHAQ, tyrosine 3-monooxygenase/tryptophan 5-monooxygenase activation protein, zeta isoform; ZNF217, zinc finger protein 217 |
| Mitotic Related Cancer Genes | Aurora kinase A (AURKA); Aurora kinase B (AURKB); Baculoviral IAP repeat-containing 5, survivin (BIRCS); Budding uninhibited by benzimidazoles 1 homolog (BUB1); Budding uninhibited by benzimidazoles 1 homolog beta, BUBR1 (BUB1B); Budding uninhibited by benzimidazoles 3 homolog (BUB3); CDC28 protein kinase regulatory subunit 1B (CKS1B); CDC28 protein kinase regulatory subunit 2 (CKS2); Cell division cycle 2 (CDC2)/CDK1 Cell division cycle 20 homolog (CDC20); Cell division cycle-associated 8, borealin (CDCA8); Centromere protein F, mitosin (CENPF); Centrosomal protein 110 kDa (CEP110);<br>Checkpoint with forkhead and ring finger domains (CHFR); Cyclin B1 (CCNB1); Cyclin B2 (CCNB2); Cytoskeleton-associated protein 5 (CKAPS/ch-TOG); Microtubule-associated protein RP/EB family member 1. End-binding protein 1, EB1 (MAPRE1); Epithelial cell transforming sequence 2 oncogene (ECT2); Extra spindle poles like 1, separase (ESPL1); Forkhead box M1 (FOXM1); H2A histone family, member X (H2AFX); Kinesin family member 4A (KIF4A); Kinetochore-associated 1 (KNTC1/ROD); Kinetochore-associated 2; highly expressed in cancer 1 (KNTC2/HEC1); Large tumor suppressor, homolog 1 (LATS1);<br>Large tumor suppressor, homolog 2 (LATS2); Mitotic arrest deficient-like 1; MAD1 (MAD1L1); Mitotic arrest deficient-like 2; MAD2 (MAD2L1); Mps1 protein kinase (TTK); Never in mitosis gene a-related kinase 2 (NEK2); Ninein, GSK3b interacting protein (NIN); Non-SMC condensin I complex, subunit D2 (NCAPD2/CNAP1); Non-SMC condensin I complex, subunit H (NACPH/CAPH); Nuclear mitotic apparatus protein 1 (NUMA1); Nucleophosmin (nucleolar phosphoprotein B23, numatrin); (NPM1); Nucleoporin (NUP98); Pericentriolar material 1 (PCM1); Pituitary tumor-transforming 1, securin (PTTG1); Polo-like<br>kinase 1 (PLK1); Polo-like kinase 4 (PLK4/SAK); Protein (peptidylprolyl cis/trans isomerase) NIMA-interacting 1 (PIN1); Protein regulator of cytokinesis 1 (PRC1); RAD21 homolog (RAD21); Ras association (RalGDS/AF-6); domain family 1 (RASSF1); Stromal antigen 1 (STAG1); Synuclein-c, breast cancer-specific protein 1 (SNCG, BCSG1); Targeting protein for Xklp2 (TPX2); Transforming, acidic coiled-coil containing protein 3 (TACC3); Ubiquitin-conjugating enzyme E2C (UBE2C); Ubiquitin-conjugating enzyme E2I (UBE2I/UBC9); ZW10 interactor, (ZWINT); ZW10, kinetochore-associated homolog (ZW10); Zwilch, kinetochore-associated homolog (ZWILCH) |
| Ribonucleoprotein complexes | Argonaute family member, Ago1, Agog, Ago3, Ago4, GW182 (TNRC6A), TNRC6B, TNRC6C, HNRNPA2B1, HNRPAB, ILF2, NCL (Nucleolin), NPM1 (Nucleophosmin), RPL10A, RPL5, RPLP1, RPS12, RPS19, SNRPG, TROVE2, apolipoprotein, apolipoprotein A, apo A-I, apo A-II, apo A-IV, apo A-V, apolipoprotein B, apo B48, apo B100, apolipoprotein C, apo C-I, apo C-II, apo C-III, apo C-IV, apolipoprotein D (ApoD), apolipoprotein E (ApoE), apolipoprotein H (ApoH), apolipoprotein L, APOL1, APOL2, APOL3, APOL4, APOL5, APOL6, APOLD1 |
| Cytokine Receptors | 4-1BB, ALCAM, B7-1, BCMA, CD14, CD30, CD40 Ligand, CEACAM-1, DR6, Dtk, Endoglin, ErbB3, E-Selectin, Fas, Flt-3L, GITR, HVEM, ICAM-3, IL-1 R4, IL-1 RI, IL-10 Rbeta, IL-17R, IL-2Rgamma, IL-21R, LIMPII, Lipocalin-2, L-Selectin, LYVE-1, MICA, MICB, NRG1-beta1, PDGF Rbeta, PECAM-1, RAGE, TIM-1, TRAIL R3, Trappin-2, uPAR, VCAM-1, XEDAR |
| Prostate and colorectal cancer vesicles | ErbB3, RAGE, Trail R3 |
| Colorectal cancer vesicles | IL-1 alpha, CA125, Filamin, Amyloid A |
| Colorectal cancer v adenoma vesicles | Involucrin, CD57, Prohibitin, Thrombospondin, Laminin B1/b1, Filamin, 14.3.3 gamma, 14.3.3 Pan |
| Colorectal adenoma vesicles | Involucrin, Prohibitin, Laminin B1/b1, IL-3, Filamin, 14.3.3 gamma, 14.3.3 Pan, MMP-15/MT2-MMP, hPL, Ubiquitin, and mRANKL |
| Brain cancer vesicles | Prohibitin, CD57, Filamin, CD18, b-2-Microglobulin, IL-2, IL-3, CD16, p170, Keratin 19, Pds1, Glicentin, SRF (Serum Response Factor), E3-binding protein (ARM1), Collagen II, SRC1 (Steroid Receptor Coactivator-1) Ab-1, Caldesmon, GFAP, TRP75/gp75, alpha-1-antichymotrypsin, Hepatic Nuclear Factor-3B, PLAP, Tyrosinase, NF kappa B/p50, Melanoma (gp100), Cyclin E, 6-Histidine, Mucin 3 (MUC3), TdT, CD21, XPA, Superoxide Dismutase, Glycogen Synthase Kinase 3b (GSK3b), CD54/ICAM-1, Thrombospondin, Gai1, CD79a mb-1, IL-1 beta, Cytochrome c, RAD1, bcl-X, CD50/ICAM-3, Neurofilament, Alkaline Phosphatase (AP), ER Ca+2 ATPase2, PCNA, F.VIII/VWF, SV40 Large T Antigen,<br>Paxillin, Fascin, CD165, GRIP1, Cdk8, Nucleophosmin (NPM), alpha-1-antitrypsin, CD32/Fcg Receptor II, Keratin 8 (phospho-specific Ser73), DRS, CD46, TID-1, MHC II (HLA-DQ), Plasma Cell Marker, DR3, Calmodulin, AIF (Apoptosis Inducing Factor), DNA Polymerase Beta, Vitamin D Receptor (VDR), Bcl10/CIPER/CLAP/mE10, Neuron Specific Enolase, CXCR4/Fusin, Neurofilament (68 kDa), PDGFR, beta, Growth Hormone (hGH), Mast Cell Chymase, Ret Oncoprotein, and Phosphotyrosine |

TABLE 4-continued

Illustrative Biomarkers

| Illustrative Class | Biomarkers |
|---|---|
| Melanoma vesicles | Caspase 5, Thrombospondin, Filamin, Ferritin, 14.3.3 gamma, 14.3.3 Pan, CD71/Transferrin Receptor, and Prostate Apoptosis Response Protein-4 |
| Head and neck cancer vesicles | 14.3.3 Pan, Filamin, 14.3.3 gamma, CD71/Transferrin Receptor, CD30, Cdk5, CD138, Thymidine Phosphorylase, Ruv 5, Thrombospondin, CD1, Von Hippel-Lindau Protein, CD46, Rad51, Ferritin, c-Abl, Actin, Muscle Specific, LewisB |
| Membrane proteins | carbonic anhydrase IX, B7, CCCL19, CCCL21, CSAp, HER-2/neu, BrE3, CD1, CD1a, CD2, CD3, CD4, CD5, CD8, CD11A, CD14, CD15, CD16, CD18, CD19, CD20, CD21, CD22, CD23, CD25, CD29, CD30, CD32b, CD33, CD37, CD38, CD40, CD40L, CD44, CD45, CD46, CD52, CD54, CD55, CD59, CD64, CD67, CD70, CD74, CD79a, CD80, CD83, CD95, CD126, CD133, CD138, CD147, CD154, CEACAM5, CEACAM-6, alpha-fetoprotein (AFP), VEGF, ED-B fibronectin, EGP-1, EGP-2, EGF receptor (ErbB1), ErbB2, ErbB3, Factor H, FHL-1, Flt-3, folate receptor, Ga 733, GROB, HMGB-1, hypoxia inducible factor (HIF), HM1.24, HER-2/neu, insulin-like growth factor (ILGF), IFN-γ, IFN-α, IL-β, IL-2R, IL-4R, IL-6R, IL-13R, IL-15R, IL-17R, IL-18R, IL-2, IL-6, IL-8, IL-12, IL-15, IL-17, IL-18, IL-25, IP-10, IGF-1R, Ia, HM1.24, gangliosides, HCG, HLA-DR, CD66a-d, MAGE, mCRP, MCP-1, MIP-1A, MIP-1B, macrophage migration-inhibitory factor (MIF), MUC1, MUC2, MUC3, MUC4, MUC5, placental growth factor (P1GF), PSA (prostate-specific antigen), PSMA, PSMA dimer, PAM4 antigen, NCA-95, NCA-90, A3, A33, Ep-CAM, KS-1, Le(y), mesothelin, S100, tenascin, TAC, Tn antigen, Thomas-Friedenreich antigens, tumor necrosis antigens, tumor angiogenesis antigens, TNF-α, TRAIL receptor (R1 and R2), VEGFR, RANTES, T101, cancer stem cell antigens, complement factors C3, C3a, C3b, C5a, C5 |
| Cluster of Differentiation (CD) proteins | CD1, CD2, CD3, CD4, CD5, CD6, CD7, CD8, CD9, CD10, CD11a, CD11b, CD11c, CD12w, CD13, CD14, CD15, CD16, CDw17, CD18, CD19, CD20, CD21, CD22, CD23, CD24, CD25, CD26, CD27, CD28, CD29, CD30, CD31, CD32, CD33, CD34, CD35, CD36, CD37, CD38, CD39, CD40, CD41, CD42, CD43, CD44, CD45, CD46, CD47, CD48, CD49a, CD49b, CD49c, CD49d, CD49e, CD49f, CD53, CD54, CD55, CD56, CD57, CD58, CD59, CD61, CD62E, CD62L, CD62P, CD63, CD68, CD69, CD71, CD72, CD73, CD74, CD80, CD81, CD82, CD83, CD86, CD87, CD88, CD89, CD90, CD91, CD95, CD96, CD100, CD103, CD105, CD106, CD107, CD107a, CD107b, CD109, CD117, CD120, CD127, CD133, CD134, CD135, CD138, CD141, CD142, CD143, CD144, CD147, CD151, CD152, CD154, CD156, CD158, CD163, CD165, CD166, CD168, CD184, CDw186, CD195, CD197, CD209, CD202a, CD220, CD221, CD235a, CD271, CD303, CD304, CD309, CD326 |
| Interleukin (IL) proteins | IL-1, IL-2, IL-3, IL-4, IL-5, IL-6, IL-7, IL-8 or CXCL8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IL-35, IL-36 |
| IL receptors | CD121a/IL1R1, CD121b/IL1R2, CD25/IL2RA, CD122/IL2RB, CD132/IL2RG, CD123/IL3RA, CD131/IL3RB, CD124/IL4R, CD132/IL2RG, CD125/IL5RA, CD131/IL3RB, CD126/IL6RA, CD130/IR6RB, CD127/IL7RA, CD132/IL2RG, CXCR1/IL8RA, CXCR2/IL8RB/CD128, CD129/IL9R, CD210/IL10RA, CDW210B/IL10RB, IL11RA, CD212/IL12RB1, IR12RB2, IL13R, IL15RA, CD4, CDw217/IL17RA, IL17RB, CDw218a/IL18R1, IL20R, IL20R, IL21R, IL22R, IL23R, IL20R, LY6E, IL20R1, IL27RA, IL28R, IL31RA |
| Mucin (MUC) proteins | MUC1, MUC2, MUC3A, MUC3B, MUC4, MUC5AC, MUC5B, MUC6, MUC7, MUC8, MUC12, MUC13, MUC15, MUC16, MUC17, MUC19, and MUC20 |
| MUC1 isoforms | mucin-1 isoform 2 precursor or mature form (NP_001018016.1), mucin-1 isoform 3 precursor or mature form (NP_001018017.1), mucin-1 isoform 5 precursor or mature form (NP_001037855.1), mucin-1 isoform 6 precursor or mature form (NP_001037856.1), mucin-1 isoform 7 precursor or mature form (NP_001037857.1), mucin-1 isoform 8 precursor or mature form (NP_001037858.1), mucin-1 isoform 9 precursor or mature form (NP_001191214.1), mucin-1 isoform 10 precursor or mature form (NP_001191215.1), mucin-1 isoform 11 precursor or mature form (NP_001191216.1), mucin-1 isoform 12 precursor or mature form (NP_001191217.1), mucin-1 isoform 13 precursor or mature form (NP_001191218.1), mucin-1 isoform 14 precursor or mature form (NP_001191219.1), mucin-1 isoform 15 precursor or mature form (NP_001191220.1), mucin-1 isoform 16 precursor or mature form (NP_001191221.1), mucin-1 isoform 17 precursor or mature form (NP_001191222.1), mucin-1 isoform 18 precursor or mature form (NP_001191223.1), mucin-1 isoform 19 precursor or mature form (NP_001191224.1), mucin-1 isoform 20 precursor or mature form (NP_001191225.1), mucin-1 isoform 21 precursor or mature form (NP_001191226.1), mucin-1 isoform 1 precursor or mature form (NP_002447.4), ENSP00000357380, ENSP00000357377, ENSP00000389098, ENSP00000357374, ENSP00000357381, ENSP00000339690, ENSP00000342814, ENSP00000357383, ENSP00000357375, ENSP00000338983, ENSP00000343482, ENSP00000406633, ENSP00000388172, ENSP00000357378, P15941-1, P15941-2, P15941-3, P15941-4, P15941-5, P15941-6, P15941-7, P15941-8, P15941-9, P15941-10, secreted isoform, membrane bound isoform, CA 27.29 (BR 27.29), CA 15-3, PAM4 reactive antigen, underglycosylated isoform, unglycosylated isoform, CanAg antigen |
| MUC1 interacting proteins | ABL1, SRC, CTNND1, ERBB2, GSK3B, JUP, PRKCD, APC, GALNT1, GALNT10, GALNT12, JUN, LCK, OSGEP, ZAP70, CTNNB1, EGFR, SOS1, ERBB3, ERBB4, GRB2, ESR1, GALNT2, GALNT4, LYN, TP53, C1GALT1, C1GALT1C1, GALNT3, GALNT6, GCNT1, GCNT4, MUC12, MUC13, MUC15, MUC17, MUC19, MUC2, MUC20, MUC3A, |

TABLE 4-continued

Illustrative Biomarkers

| Illustrative Class | Biomarkers |
|---|---|
| | MUC4, MUC5B, MUC6, MUC7, MUCL1, ST3GAL1, ST3GAL3, ST3GAL4, ST6GALNAC2, B3GNT2, B3GNT3, B3GNT4, B3GNT5, B3GNT7, B4GALT5, GALNT11, GALNT13, GALNT14, GALNT5, GALNT8, GALNT9, ST3GAL2, ST6GAL1, ST6GALNAC4, GALNT15, MYOD1, SIGLEC1, IKBKB, TNFRSF1A, IKBKG, MUC1 |
| Tumor markers | Alphafetoprotein (AFP), Carcinoembryonic antigen (CEA), CA-125, MUC-1, Epithelial tumor antigen (ETA), Tyrosinase, Melanoma-associated antigen (MAGE), p53 |
| Tumor markers | Alpha fetoprotein (AFP), CA15-3, CA27-29, CA19-9, CA-125, Calretinin, Carcinoembryonic antigen, CD34, CD99, CD117, Chromogranin, Cytokeratin (various types), Desmin, Epithelial membrane protein (EMA), Factor VIII, CD31 FL1, Glial fibrillary acidic protein (GFAP), Gross cystic disease fluid protein (GCDFP-15), HMB-45, Human chorionic gonadotropin (hCG), immunoglobulin, inhibin, keratin (various types), PTPRC (CD45), lymphocyte marker (various types, MART-1 (Melan-A), Myo D1, muscle-specific actin (MSA), neurofilament, neuron-specific enolase (NSE), placental alkaline phosphatase (PLAP), prostate-specific antigen, S100 protein, smooth muscle actin (SMA), synaptophysin, thyroglobulin, thyroid transcription factor-1, Tumor M2-PK, vimentin |
| Cell adhesion molecule (CAMs) | Immunoglobulin superfamily CAMs (IgSF CAMs), N-CAM (Myelin protein zero), ICAM (1, 5), VCAM-1, PE-CAM, L1-CAM, Nectin (PVRL1, PVRL2, PVRL3), Integrins, LFA-1 (CD11a + CD18), Integrin alphaXbeta2 (CD11c + CD18), Macrophage-1 antigen (CD11b + CD18), VLA-4 (CD49d + CD29), Glycoprotein IIb/IIIa (ITGA2B+ITGB3), Cadherins, CDH1, CDH2, CDH3, Desmosomal, Desmoglein (DSG1, DSG2, DSG3, DSG4), Desmocollin (DSC1, DSC2, DSC3), Protocadherin, PCDH1, T-cadherin, CDH4, CDH5, CDH6, CDH8, CDH11, CDH12, CDH15, CDH16, CDH17, CDH9, CDH10, Selectins, E-selectin, L-selectin, P-selectin, Lymphocyte homing receptor: CD44, L-selectin, integrin (VLA-4, LFA-1), Carcinoembryonic antigen (CEA), CD22, CD24, CD44, CD146, CD164 |
| Annexins | ANXA1; ANXA10; ANXA11; ANXA13; ANXA2; ANXA3; ANXA4; ANXA5; ANXA6; ANXA7; ANXA8; ANXA8L1; ANXA8L2; ANXA9 |
| Cadherins ("calcium-dependent adhesion") | CDH1, CDH2, CDH12, CDH3, Deomoglein, DSG1, DSG2, DSG3, DSG4, Desmocollin, DSC1, DSC2, DSC3, Protocadherins, PCDH1, PCDH10, PCDH11x, PCDH11y, PCDH12, FAT, FAT2, FAT4, PCDH15, PCDH17, PCDH18, PCDH19; PCDH2O; PCDH7, PCDH8, PCDH9, PCDHAL PCDHA10, PCDHA11, PCDHA12, PCDHA13, PCDHA2, PCDHA3, PCDHA4, PCDHA5, PCDHA6, PCDHA7, PCDHA8, PCDHA9, PCDHAC1, PCDHAC2, PCDHB1, PCDHB10, PCDHB11, PCDHB12, PCDHB13, PCDHB14, PCDHB15, PCDHB16, PCDHB17, PCDHB18, PCDHB2, PCDHB3, PCDHB4, PCDHB5, PCDHB6, PCDHB7, PCDHB8, PCDHB9, PCDHGA1, PCDHGA10, PCDHGA11, PCDHGA12, PCDHGA2; PCDHGA3, PCDHGA4, PCDHGA5, PCDHGA6, PCDHGA7, PCDHGA8, PCDHGA9, PCDHGB1, PCDHGB2, PCDHGB3, PCDHGB4, PCDHGB5, PCDHGB6, PCDHGB7, PCDHGC3, PCDHGC4, PCDHGC5, CDH9 (cadherin 9, type 2 (T1-cadherin)), CDH10 (cadherin 10, type 2 (T2-cadherin)), CDH5 (VE-cadherin (vascular endothelial)), CDH6 (K-cadherin (kidney)), CDH7 (cadherin 7, type 2), CDH8 (cadherin 8, type 2), CDH11 (OB-cadherin (osteoblast)), CDH13 (T-cadherin - H-cadherin (heart)), CDH15 (M-cadherin (myotubule)), CDH16 (KSP-cadherin), CDH17 (LI cadherin (liver-intestine)), CDH18 (cadherin 18, type 2), CDH19 (cadherin 19, type 2), CDH20 (cadherin 20, type 2), CDH23 (cadherin 23, (neurosensory epithelium)), CDH10, CDH11, CDH13, CDH15, CDH16, CDH17, CDH18, CDH19, CDH2O, CDH22, CDH23, CDH24, CDH26, CDH28, CDH4, CDH5, CDH6, CDH7, CDH8, CDH9, CELSR1, CELSR2, CELSR3, CLSTN1, CLSTN2, CLSTN3, DCHS1, DCHS2, LOC389118, PCLKC, RESDA1, RET |
| ECAD (CDH1) downregulators | SNAI1/SNAIL, ZFHX1B/SIP1, SNAI2/SLUG, TWIST1, DeltaEF1 |
| ECAD upregulators | AML1, p300, HNF3 |
| ECAD interacting proteins | ACADVL, ACTG1, ACTN1, ACTN4, ACTR3, ADAM10, ADAM9, AJAP1, ANAPC1, ANAPC11, ANAPC4, ANAPC7, ANK2, ANP32B, APC2, ARHGAP32, ARPC2, ARVCF, BOC, C1QBP, CA9, CASP3, CASP8, CAV1, CBLL1, CCNB1, CCND1, CCT6A, CDC16, CDC23, CDC26, CDC27, CDC42, CDH2, CDH3, CDK5R1, CDON, CDR2, CFTR, CREBBP, CSE1L, CSNK2A1, CTNNA1, CTNNB1, CTNND1, CTNND2, DNAJA1, DRG1, EGFR, EP300, ERBB2, ERBB2IP, ERG, EZR, FER, FGFR1, FOXM1, FRMD5, FYN, GBAS, GNA12, GNA13, GNB2L1, GSK3B, HDAC1, HDAC2, HSP90AA1, HSPA1A, HSPA1B, HSPD1, IGHA1, IQGAP1, IRS1, ITGAE, ITGB7, JUP, KIFC3, KLRG1, KRT1, KRT9, LIMA1, LMNA, MAD2L2, MAGI1, MAK, MDM2, MET, MYO6, MYO7A, NDRG1, NEDD9, NIPSNAP1, NKD2, PHLPP1, PIP5K1C, PKD1, PKP4, PLEKHA7, POLR2E, PPP1CA, PRKD1, PSEN1, PTPN1, PTPN14, PTPRF, PTPRM, PTPRQ, PTTG1, PVR, PVRL1, RAB8B, RRM2, SCRIB, SET, SIX1, SKI, SKP2, SRC, TACC3, TAS2R13, TGM2, TJP1, TK1, TNS3, TTK, UBC, USP9X, VCL, VEZT, XRCC5, YAP1, YES1, ZC3HC1 |
| Epithelial-mesenchymal transition (EMT) | SERPINA3, ACTN1, AGR2, AKAP12, ALCAM, AP1M2, AXL, BSPRY, CCL2, CDH1, CDH2, CEP170, CLDN3, CLDN4, CNN3, CYP4X1, DNMT3A, DSG3, DSP, EFNB2, EHF, ELF3, ELF5, ERBB3, ETV5, FLRT3, FOSB, FOSl1, FOXC1, FX YD 5, GPDIL, HMGA1, HMGA2, HOPX, IFI16, IGFBP2, IHH, IKBIP, IL-11, IL-18, IL6, IL8, ITGA5, ITGB3, LAMB1, LCN2, MAP7, MB, MMP7, MMP9, MPZL2, MSLN, MTA3, MTSS1, OCLN, PCOLCE2, PECAM1, PLAUR, PLXNB1, PPL, PPP1R9A, RASSF8, SCNN1A, SERPINB2, SERPINE1, SFRP1, SH3YL1, SLC27A2, SMAD7, SNAI1, SNAI2, SPARC, SPDEF, SRPX, |

TABLE 4-continued

Illustrative Biomarkers

| Illustrative Class | Biomarkers |
|---|---|
| | STAT5A, TBX2, TJP3, TMEM125, TMEM45B, TWIST1, VCAN, VIM, VWF, XBP1, YBX1, ZBTB10, ZEB1, ZEB2 |

Examples of additional biomarkers that can be incorporated into the methods and compositions of the invention include without limitation those disclosed in International Patent Application Nos. PCT/US2012/042519, filed Jun. 14, 2012 and PCT/US2012/050030, ref. no. 37901-797.602), filed Aug. 8, 2012.

In various embodiments of the invention, the biomarkers or biosignature used to detect or assess any of the conditions or diseases disclosed herein can comprise one or more biomarkers in one of several different categories of markers, wherein the categories include without limitation one or more of: 1) disease specific biomarkers; 2) cell- or tissue-specific biomarkers; 3) vesicle-specific markers (e.g., general vesicle biomarkers); 4. angiogenesis-specific biomarkers; and 5) immunomodulatory biomarkers. Examples of such markers are disclosed herein and known to a person having ordinary skill in the art. Furthermore, a biomarker known in the art that is characterized to have a role in a particular disease or condition can be adapted for use as a target in compositions and methods of the invention. In further embodiments, such biomarkers that are associated with vesicles can be all vesicle surface markers, or a combination of vesicle surface markers and vesicle payload markers (i.e., molecules enclosed by a vesicle). The biomarkers assessed can be from a combination of sources. For example, a disease or disorder may be detected or characterized by assessing a combination of proteins, nucleic acids, vesicles, circulating biomarkers, biomarkers from a tissue sample, and the like. In addition, as noted herein, the biological sample assessed can be any biological fluid, or can comprise individual components present within such biological fluid (e.g., vesicles, nucleic acids, proteins, or complexes thereof).

EpCAM is a pan-epithelial differentiation antigen that is expressed on many tumor cells. It is intricately linked with the Cadherin-Catenin pathway and hence the fundamental WNT pathway responsible for intracellular signalling and polarity. It has been used as an immunotherapeutic target in the treatment of gastrointestinal, urological and other carcinomas. (Chaudry M A, Sales K, Ruf P, Lindhofer H, Winslet M C (April 2007). Br. J. Cancer 96 (7): 1013-9.). It is expressed in undifferentiated pluripotent stem cells. EpCAM is a member of a family that includes at least two type I membrane proteins and functions as a homotypic calcium-independent cell adhesion molecule. Mutations in this gene result in congenital tufting enteropathy. EpCAM has been observed on the surface of microvesicles derived from cancer cell of various lineages. EpCAM is used as an exemplary surface antigen in various examples herein. One of skill will appreciate that various embodiments and examples using EpCAM can also be applied to other biomarkers, including other microvesicle surface antigens.

Therapeutics

As used herein "therapeutically effective amount" refers to an amount of a composition that relieves (to some extent, as judged by a skilled medical practitioner) one or more symptoms of the disease or condition in a mammal. Additionally, by "therapeutically effective amount" of a composition is meant an amount that returns to normal, either partially or completely, physiological or biochemical parameters associated with or causative of a disease or condition. A clinician skilled in the art can determine the therapeutically effective amount of a composition in order to treat or prevent a particular disease condition, or disorder when it is administered, such as intravenously, subcutaneously, intraperitoneally, orally, or through inhalation. The precise amount of the composition required to be therapeutically effective will depend upon numerous factors, e.g., such as the specific activity of the active agent, the delivery device employed, physical characteristics of the agent, purpose for the administration, in addition to many patient specific considerations. But a determination of a therapeutically effective amount is within the skill of an ordinarily skilled clinician upon the appreciation of the disclosure set forth herein.

The terms "treating," "treatment," "therapy," and "therapeutic treatment" as used herein refer to curative therapy, prophylactic therapy, or preventative therapy. An example of "preventative therapy" is the prevention or lessening the chance of a targeted disease (e.g., cancer or other proliferative disease) or related condition thereto. Those in need of treatment include those already with the disease or condition as well as those prone to have the disease or condition to be prevented. The terms "treating," "treatment," "therapy," and "therapeutic treatment" as used herein also describe the management and care of a mammal for the purpose of combating a disease, or related condition, and includes the administration of a composition to alleviate the symptoms, side effects, or other complications of the disease, condition. Therapeutic treatment for cancer includes, but is not limited to, surgery, chemotherapy, radiation therapy, gene therapy, and immunotherapy.

As used herein, the term "agent" or "drug" or "therapeutic agent" refers to a chemical compound, a mixture of chemical compounds, a biological macromolecule, or an extract made from biological materials such as bacteria, plants, fungi, or animal (particularly mammalian) cells or tissues that are suspected of having therapeutic properties. The agent or drug can be purified, substantially purified or partially purified. An "agent" according to the present invention, also includes a radiation therapy agent or a "chemotherapuetic agent."

As used herein, the term "diagnostic agent" refers to any chemical used in the imaging of diseased tissue, such as, e.g., a tumor.

As used herein, the term "chemotherapuetic agent" refers to an agent with activity against cancer, neoplastic, and/or proliferative diseases, or that has ability to kill cancerous cells directly.

As used herein, "pharmaceutical formulations" include formulations for human and veterinary use with no significant adverse toxicological effect. "Pharmaceutically acceptable formulation" as used herein refers to a composition or formulation that allows for the effective distribution of the nucleic acid molecules of the instant invention in the physical location most suitable for their desired activity.

As used herein the term "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated.

Aptamer-Toxin Conjugates as a Cancer Therapeutic

Extensive previous work has developed the concept of antibody-toxin conjugates ("immunoconjugates") as potential therapies for a range of indications, mostly directed at the treatment of cancer with a primary focus on hematological tumors. A variety of different payloads for targeted delivery have been tested in pre-clinical and clinical studies, including protein toxins, high potency small molecule cytotoxics, radioisotopes, and liposome-encapsulated drugs. While these efforts have successfully yielded three FDA-approved therapies for hematological tumors, immunoconjugates as a class (especially for solid tumors) have historically yielded disappointing results that have been attributable to multiple different properties of antibodies, including tendencies to develop neutralizing antibody responses to non-humanized antibodies, limited penetration in solid tumors, loss of target binding affinity as a result of toxin conjugation, and imbalances between antibody half-life and toxin conjugate half-life that limit the overall therapeutic index (reviewed by Reff and Heard, Critical Reviews in Oncology/Hematology, 40 (2001):25-35).

Aptamers are functionally similar to antibodies, except their absorption, distribution, metabolism, and excretion ("ADME") properties are intrinsically different and they generally lack many of the immune effector functions generally associated with antibodies (e.g., antibody-dependent cellular cytotoxicity, complement-dependent cytotoxicity). In comparing many of the properties of aptamers and antibodies previously described, several factors suggest that toxin-delivery via aptamers offers several concrete advantages over delivery with antibodies, ultimately affording them better potential as therapeutics. Several examples of the advantages of toxin-delivery via aptamers over antibodies are as follows:

1) Aptamer-toxin conjugates are entirely chemically synthesized. Chemical synthesis provides more control over the nature of the conjugate. For example, the stoichiometry (ratio of toxins per aptamer) and site of attachment can be precisely defined. Different linker chemistries can be readily tested. The reversibility of aptamer folding means that loss of activity during conjugation is unlikely and provides more flexibility in adjusting conjugation conditions to maximize yields.

2) Smaller size allows better tumor penetration. Poor penetration of antibodies into solid tumors is often cited as a factor limiting the efficacy of conjugate approaches. See Colcher, D., Goel, A., Pavlinkova, G., Beresford, G., Booth, B., Batra, S. K. (1999) "Effects of genetic engineering on the pharmacokinetics of antibodies," Q. J. Nucl. Med., 43: 132-139. Studies comparing the properties of unPEGylated anti-tenascin C aptamers with corresponding antibodies demonstrate efficient uptake into tumors (as defined by the tumor:blood ratio) and evidence that aptamer localized to the tumor is unexpectedly long-lived ($t_{1/2}$>12 hours) (Hicke, B. J., Stephens, A. W., "Escort aptamers: a delivery service for diagnosis and therapy", J. Clin. Invest., 106:923-928 (2000)).

3) Tunable PK. Aptamer half-life/metabolism can be easily tuned to match properties of payload, optimizing the ability to deliver toxin to the tumor while minimizing systemic exposure. Appropriate modifications to the aptamer backbone and addition of high molecular weight PEGs should make it possible to match the half-life of the aptamer to the intrinsic half-life of the conjugated toxin/linker, minimizing systemic exposure to non-functional toxin-bearing metabolites (expected if $t_{1/2}$(aptamer)<<$t_{1/2}$(toxin)) and reducing the likelihood that persisting unconjugated aptamer will functionally block uptake of conjugated aptamer (expected if $t_{1/2}$(aptamer)>>$t_{1/2}$ (toxin)).

4) Relatively low material requirements. It is likely that dosing levels will be limited by toxicity intrinsic to the cytotoxic payload. As such, a single course of treatment will likely entail relatively small (<100 mg) quantities of aptamer, reducing the likelihood that the cost of oligonucleotide synthesis will be a barrier for aptamer-based therapies.

5) Parenteral administration is preferred for this indication. There will be no special need to develop alternative formulations to drive patient/physician acceptance.

Aptamer Identification Methods

Nucleic acid sequences fold into secondary and tertiary motifs particular to their nucleotide sequence. These motifs position the positive and negative charges on the nucleic acid sequences in locations that enable the sequences to bind to specific locations on target molecules, e.g., proteins and other amino acid sequences. These binding sequences are known in the field as aptamers. Due to the trillions of possible unique nucleotide sequences in even a relatively short stretch of nucleotides (e.g., 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides), a large variety of motifs can be generated, resulting in aptamers for almost any desired protein or other target.

Aptamers are created by randomly generating oligonucleotides of a specific length, typically 20-80 base pairs long, e.g., 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79 or 80 base pairs. These random oligonucleotides are then incubated with the protein target of interest. After several wash steps, the oligonucleotides that bind to the target are collected and amplified. The amplified aptamers are then added to the target and the process is repeated, often 15-20 times. A common version of this process known to those of skill in the art as the SELEX method.

The end result comprises one or more aptamer with high affinity to the target. The invention provides further processing of such resulting aptamers that can be use to provide desirable characteristics: 1) competitive binding assays to identify aptamers to a desired epitope; 2) motif analysis to identify high affinity binding aptamers in silico; and 3) microvesicle-based aptamer selection assays to identify aptamers that can be used to detect a particular disease. The invention also provides use of the aptamers to detect a target of interest, e.g., to detect a biological entity such as a protein, nucleic acid, or microvesicle. Aptamers of the invention may bind to functional groups of interest, e.g., carboxyl groups, for use as blocking agents, negative controls, and the like. The methods are described in more detail below and further in the Examples.

The invention further contemplates aptamer sequences that are highly homologous to the sequences that are discovered by the methods of the invention. "High homology" typically refers to a homology of 40% or higher, preferably 60% or higher, more preferably 80% or higher, even more preferably 85%, 90%, 91%, 92%, 93%, 94%, 95%, 96%, 97%, 98%, 99% or higher between a polynucleotide sequence sequence and a reference sequence. In an embodiment, the reference sequence comprises the sequence of one or more aptamer provided herein. Percent homologies (also referred to as percent identity) are typically carried out between two optimally aligned sequences. Methods of alignment of sequences for comparison are well-known in the art. Optimal alignment of sequences and comparison can be conducted, e.g., using the algorithm in "Wilbur and Lipman, Proc Natl Acad Sci USA 80: 726-30 (1983)". Homology calculations can also be performed using BLAST, which can be found on the NCBI server at: www.ncbi.nlm.nih.gov/BLAST/(Altschul S F, et al, Nucleic Acids Res. 1997; 25(17):3389-402; Altschul S F, et al, J Mol. Biol. 1990; 215(3):403-10). In the case of an isolated polynucleotide which is longer than or equivalent in length to the reference sequence, e.g., a sequence identified by the methods herein, the comparison is made with the full length of the reference sequence. Where the isolated polynucleotide is shorter than the reference sequence, e.g., shorter than a sequence identified by the methods herein, the comparison is made to a segment of the reference sequence of the same length (excluding any loop required by the homology calculation).

The invention further contemplates aptamer sequences that are functional fragments of the sequences that are discovered by the methods of the invention. In the context of an aptamer sequence, a "functional fragment" of the aptamer sequence may comprise a subsequence that binds to the same target as the full length sequence. In some instances, a candidate aptamer sequence is from a member of a library that contains a 5' leader sequences and/or a 3' tail sequence. Such leader sequences or tail sequences may serve to facilitate primer binding for amplification or capture, etc. In these embodiments, the functional fragment of the full length sequence may comprise the subsequence of the candidate aptamer sequence absent the leader and/or tail sequences.

Competitive Antibody Addition

Known aptamer production methods may involve eluting all bound aptamers from the target sequence. In some cases, this is not sufficient to identify the desired aptamer sequence. For example, when trying to replace an antibody in an assay, it may be desirable to only collect aptamers that bind to the specific epitope of the antibody being replaced. The invention provides a method comprising addition of an antibody that is to be replaced to the aptamer/target reaction in order to allow for the selective collection of aptamers which bind to the antibody epitope. In an embodiment, the method comprises incubating a reaction mixture comprising randomly generated oligonucleotides with a target of interest, removing unbound aptamers from the reaction mixture that do not bind the target, adding an antibody to the reaction mixture that binds to that epitope of interest, and collecting the aptamers that are displaced by the antibody. The target can be a protein.

Figure 2A:
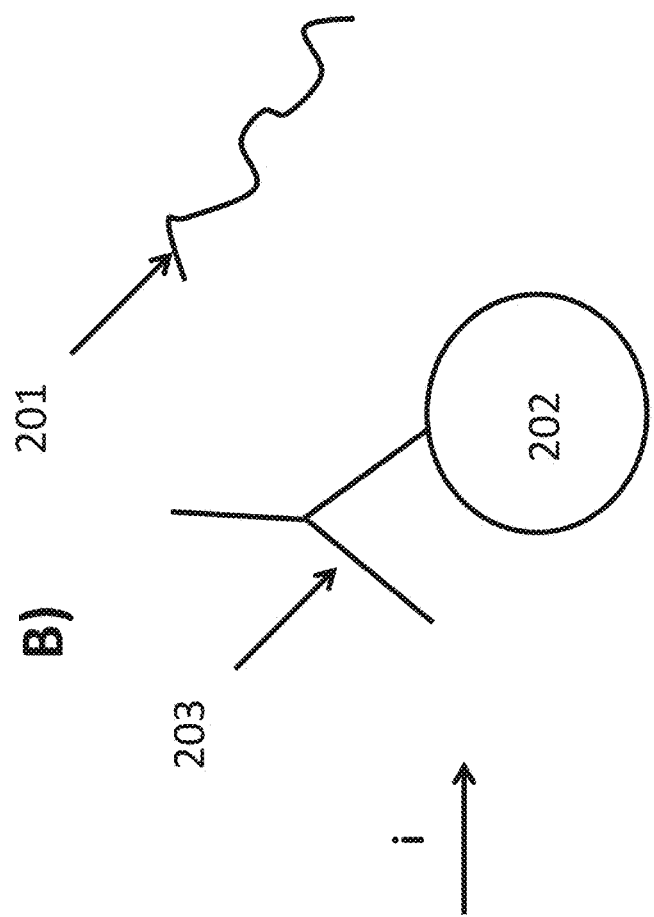
FIGS. 2A-2B illustrate a competitive assay selection strategy. A random pool of nucleic acid aptamer candidates (the library) are incubated with a target of interest 202. Multiple rounds of binding can be performed wherein: 1) the library is incubated with the target; 2) the library-target mixture is washed to remove unbound aptamer candidates; 3) bound aptamer candidates are eluted from the target; and 4) the eluted aptamer candidates are again added to the target and allowed to bind.
Figure 2B:
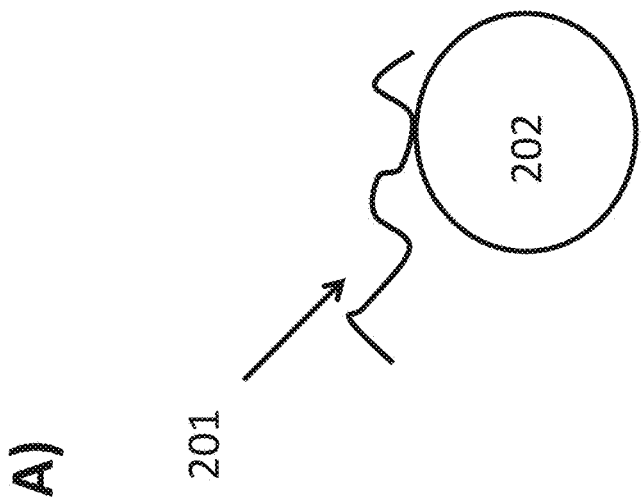

FIGS. 2A-2B illustrate a competitive assay selection strategy. A random pool of nucleic acid aptamer candidates (the library) are incubated with a target of interest 202. Multiple rounds of binding can be performed wherein: 1) the library is incubated with the target; 2) the library-target mixture is washed to remove unbound aptamer candidates; 3) bound aptamer candidates are eluted from the target; and 4) the eluted aptamer candidates are again added to the target and allowed to bind. FIG. 2A illustrates aptamer candidate 201 bound to target 202. In step i), a competing antibody 203 is then added to the reaction. FIG. 2B illustrates candidate antibody 203 competing with aptamer candidate 201 at the epitope of the antibody. Aptamer candidate 201 is displaced by the antibody and then collected.

Competitive Binding

As described herein, aptamers can be identified against a target of interest. A competitive binding scheme 30 can be used to identify aptamers against a target of interest, as outlined in FIG. 3. An analyte of interest, e.g., a biological entity such as a protein or microvesicle, is captured to a substrate 31. The substrate can be, e.g., a planar substrate or bead. The analyte can be captured covalently or non-covalently, e.g., the analyte can be captured using an antibody, aptamer, or streptavidin-biotin linkage. The captured analyte is contacted with a pool of oligonucleotide aptamer candidates 32. In an embodiment, the pool comprises randomly generated oligonucleotides, e.g., at least 10, $10^2$, $10^3$, $10^4$, $10^5$, $10^6$, $10^7$, $10^8$, $10^9$, $10^{10}$, $10^{11}$, $10^{12}$, $10^{13}$, $10^{23}$, $10^{15}$, $10^{16}$, $10^{17}$, $10^{18}$, $10^{19}$ or at least $10^{20}$ oligonucleotides. The oligonucleotides bind to various components in the mixture, including the analyte, the substrate, the capture agent (e.g., antibody (Ab), aptamer, etc), reaction tube or well, biological debris, etc 33. Oligonucleotides that bind the analyte comprise aptamer candidates to the target of interest 34. Unbound oligonucleotides are removed via washing 35. After this step, the reaction mixture comprises the capture analyte bound by aptamer candidates. A ligand that recognizes a specific epitope, e.g., an antibody, is contacted with the reaction mixture 37. The ligand disassociates aptamer candidates bound to the same epitope as the ligand via competition for the epitope 38. The disassociated aptamer candidates are collected and amplified 39. Steps 32-39 are repeated a set number of times, n, e.g., 1, 2, 3, 4, 5, 6, 7, 8, 9, 10, 11, 12, 13, 14, 15, 16, 17, 18, 19 or 20 times, to further enrich the aptamer candidates with those that bind to the same epitope as the ligand. After the repeated cycles, the remaining aptamers are assessed by sequencing, and other characterizations 310 as described herein.

Control screening is performed in parallel with the above method. Any aptamer identified via the control screening are discarded. Controls analytes include without limitation bare substrate incubated with the analyte, bare substrate without the analyte, and the method performed with a control ligand, such as an antibody that does not bind a target of interest.

The ligand can be an antibody to a biomarker of interest. The method may be used to identify an aptamer to substitute for an antibody in a biological assay. For example, the aptamer may be produced more reproducibly and efficiently than an equivalent antibody. The biomarker may be any useful biomarker, including without limitation a biomarker in Table 3 or 4. In an embodiment, the biomarker is a microvesicle surface antigen selected from Table 3 or 4.

In an embodiment, the invention provides a method of selecting a group of aptamers, comprising: (a) contacting a pool of aptamer candidates to a sample comprising a target molecule; (b) removing unbound aptamer candidates; (c) contacting the sample with a ligand to the target molecule; and (d) isolating aptamer candidates that are disassociated from the target molecule by competition with the ligand, thereby selecting the group of aptamers that bind the same target as the ligand. The target molecule may be a protein. The protein can be a microvesicle surface antigen. The surface antigen may be isolated from a microvesicle or remain embedded within a microvesicle membrane. The target molecule may be directly or indirectly tethered to a substrate. For example, the target molecule can be a protein that is bound by an antibody or aptamer on the substrate surface. In another example, the target molecule is a surface antigen of a microvesicle and the microvesicle is tethered to the substrate.

The ligand used to displace the aptamer candidates may comprise a small molecule or protein. In some embodiment, the ligand comprises an antibody. Thus the method can be used to identify aptamers that bind the same epitope as an antibody.

As described herein, steps (a)-(d) can be repeated 1, 2, 3, 4, 5, 6, 7, 8, 9, 10, 11, 12, 13, 14, 15, 16, 17, 18, 19 or 20 times, wherein the aptamer candidates isolated in the step (d) are used the pool of aptamer candidates input into step (a) in each iteration. This iterative process is used to further enrich the pool of aptamer candidates with those that bind the same target as the ligand.

The members of the selected group of aptamers may be identified for further characterization. In some embodiments, the identifying is performed by high throughput sequencing (HTS). The HTS can be Next Generation sequencing.

Motif Analysis

In most aptamer experiments, multiple aptamer sequences are identified that bind to the target. These aptamers will have various binding affinities. It can be time consuming and laborious to generate quantities of these many aptamers sufficient to assess the affinities of each. To identify large numbers of aptamers with the highest affinities without physically screening large subsets, the invention provides a method comprising the analysis of the two dimensional structure of one or more high affinity aptamers to the target of interest. In an embodiment, the method comprises screening the database for aptamers that have similar two-dimensional structures, or motifs, but not necessarily similar primary sequences. In an embodiment, the method comprises identifying a high affinity aptamer using traditional methods such as disclosed herein or known in the art (e.g. surface plasmon resonance binding assay, see, e.g., FIG. 4), approximating the two-dimensional structure of the high affinity aptamer, and identifying aptamers from a pool of sequences that are predicted to have a similar two-dimensional structure to the high affinity aptamer. The method thereby provides a pool of candidates that also bind the target of interest. The two-dimensional structure of an oligo can be predicting using methods known in the art, e.g., via free energy ($\Delta G$) calculations performed using a commercially available software program such as Vienna or mFold, for example as described in Mathews, D., Sabina, J., Zucker, M. & Turner, H. Expanded sequence dependence of thermodynamic parameters provides robust prediction of RNA secondary structure. J. Mol. Biol. 288, 911-940 (1999); Hofacker et al., Monatshefte f. Chemie 125: 167-188 (1994); and Hofacker, I. L. Vienna RNA secondary structure server. Nucleic Acids Res. 31, 3429-3431 (2003), the contents of which are incorporated herein by reference in their entirety. See FIGS. 5A-5B. The pool of sequences can be sequenced from a pool of randomly generated aptamer candidates using a high-throughput sequencing platform, such as the Ion Torrent platform from Life Technologies. Identifying aptamers from a pool of sequences that are predicted to have a similar two-dimensional structure to the high affinity aptamer may comprise loading the resulting sequences into the software program of choice to identify members of the pool of sequences with similar two-dimensional structures as the high affinity aptamer. The affinities of the pool of sequences can then be determined in situ, e.g., surface plasmon resonance binding assay or the like.

Aptamer Subtraction Methods

In order to develop an assay to detect a disease, for example, cancer, one typically screens a large population of known biomarkers from normal and diseased patients in order to identify markers that correlate with disease. This process only works if discriminating markers are already described. In order to address this problem, the invention provides a method comprising subtracting out non-discriminating aptamers from a large pool of aptamers by incubating them initially with non-target microvesicles or cells. The non-target cells can be normal cells or microvesicles shed therefrom. The aptamers that did not bind to the normal microvesicles or cells are then incubated with diseased microvesicles or cells. The aptamers that bind to the diseased microvesicles or cells but that did not bind to the normal cells are then possible candidates for an assay to detect the disease. This process is independent of knowing the existence of a particular marker in the diseased sample.

Subtraction methods can be used to identify aptamers that preferentially recognize a desired population of targets. In an embodiment, the subtraction method is used to identify aptamers that preferentially recognize target from a diseased target population over a control (e.g., normal or non-diseased) population. The diseased target population may be a population of vesicles from a diseased individual or individuals, whereas the control population comprises vesicles from a non-diseased individual or individuals. The disease can be a cancer or other disease disclosed herein or known in the art. Accordingly, the method provides aptamers that preferentially identify disease targets versus control targets.

Circulating microvesicles are isolated from control plasma, e.g., plasma from "normal" individuals that are absent a disease of interest, such as an absence of cancer. Vesicles in the plasma are isolated using a method disclosed herein or as known in the art. For example, vesicles can be isolated from the plasma by one of the following methods: filtration, ExoQuick reagent, ultracentrifugation, using a molecular crowding reagent (e.g., TEXIS from Life Technologies), affinity isolation, affinity selection, or a combination of any of these methods. The microvesicles isolated in each case will be a mixture of vesicle types and will be various sizes with the exception of the ultracentrifugation methods, which has a tendency to produce exosomal-sized vesicles. Randomly generated oligonucleotide libraries (e.g., produced as described in Example 1 below) are incubated with the isolated normal vesicles. The aptamers that do not bind to these vesicles are isolated, e.g., by spinning down the vesicles and collecting the supernatant containing the non-binding aptamers. These non-binding aptamers are then contacted with vesicles isolated from diseased patients (e.g., using the same methods as described above) to allow the aptamers to recognize the disease vesicles. Next, aptamers that are bound to the diseased vesicles are collected. In an embodiment, the vesicles are isolated then lysed using a chaotropic agent (e.g., SDS or a similar detergent), and the aptamers are then captured by running the lysis mixture over an affinity column. The affinity column may comprise streptavidin beads in the case of biotin conjugated aptamer pools. The isolated aptamers are the amplified. The process can then then repeated, e.g., 1, 2, 3, 4, 5, 6, 7, 8, 9, 10, 11, 12, 13, 14, 15, 16, 17, 18, 19 or 20 or more times.

In one aspect of the invention, an aptamer profile is identified that can be used to characterize a biological sample of interest. In an embodiment, a pool of randomly generated oligonucleotides, e.g., at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ oligonucleotides, is contacted with a biological component or target of interest from a control population. The oligonucleotides that do not bind the biological component or target of interest from the control population are isolated and then contacted with a biological component or target of interest from a test population. The oligonucleotides that bind the biological component or target of interest from the test population are retained. The retained oligonucleotides can be used to repeat the process by contacting the retained oligonucleotides with the biological component or target of interest from the control population, isolating the retained oligonucleotides that do not bind the the biological component or target of interest from the control population, and again contacting these isolated oligonucleotides with the biological component or target of interest from the test population and isolating the binding oligonucleotides. The "component" or "target" can be anything that is present in sample to which the oligonucleotides are capable of binding (e.g., polypeptides, peptide, nucleic acid molecules, carbodyhrates, lipids, etc.). The process is then repeated, e.g., 1, 2, 3, 4, 5, 6, 7, 8, 9, 10 or more times. The resulting oligonucleotides comprise aptamers that can differentially detect the test population versus the control. These aptamers provide an aptamer profile, which comprises a biosignature that is determined using one or more aptamer, e.g., a biosignature comprising a presense or level of the component or target which is detected using the one or more aptamer.

Figure 6:
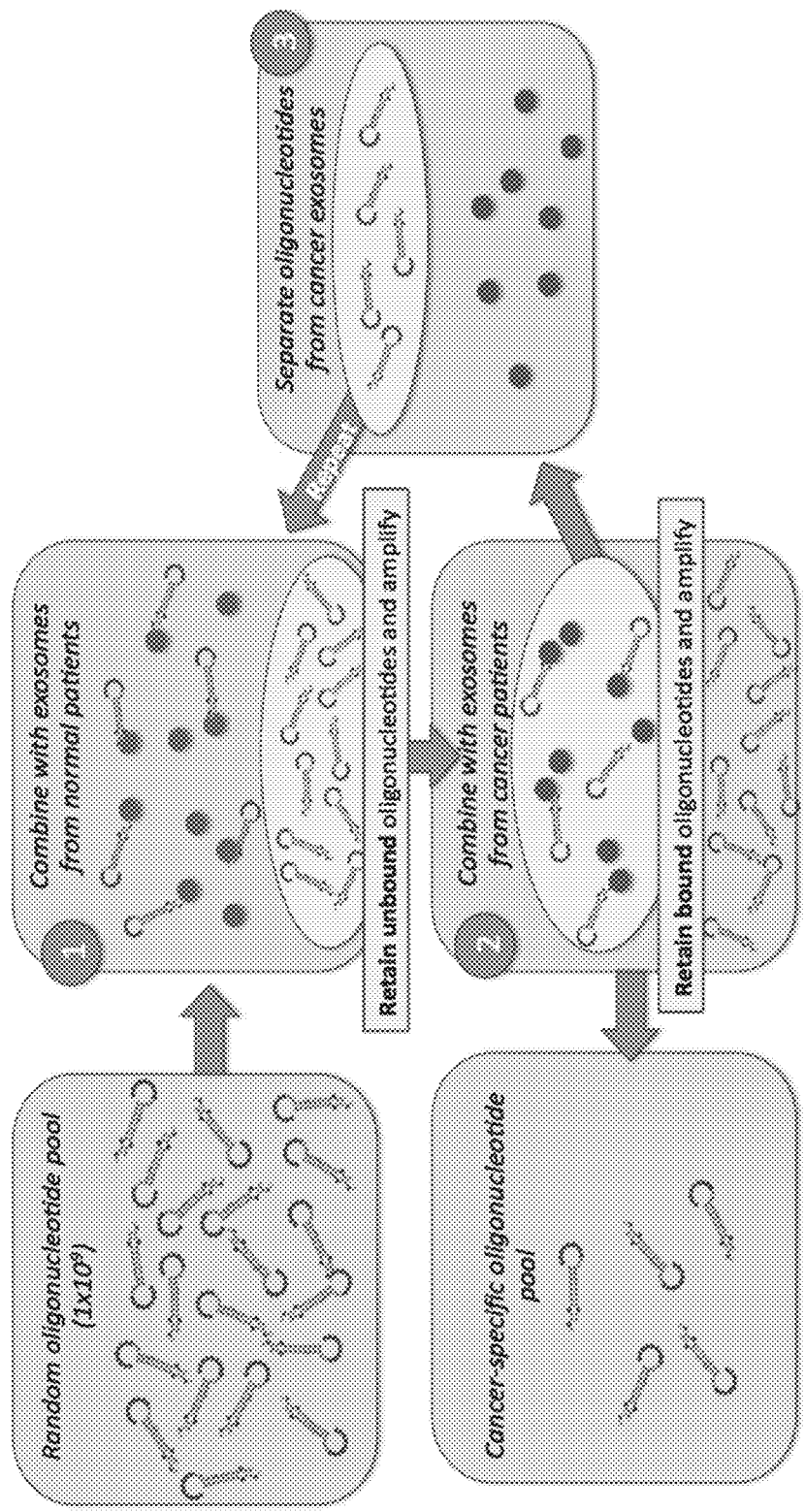
FIG. 6 illustrates a process for producing a target-specific set of aptamers using a cell subtraction method, wherein the target is a biomarker associated with a specific disease. In Step 1, a random pool of oligonucleotides are contacted with a biological sample from a normal patient. In Step 2, the oligos that did not bind in Step 1 are added to a biological sample isolated from diseased patients. The bound oligos from this step are then eluted, captured via their biotin linkage and then combined again with normal biological sample. The unbound oligos are then added again to disease-derived biological sample and isolated. This process can be repeated iteratively. The final eluted aptamers are tested against patient samples to measure the sensitivity and specificity of the set. Biological samples can include blood, including plasma or serum, or other components of the circulatory system, such as microvesicles.

An exemplary process is illustrated in FIG. 6, which demonstrates the method to identify aptamer that preferentially recognize cancer vesicles using vesicles from normal (non-cancer) individuals as a control. In the figure, exosomes are exemplified but one of skill will appreciate that other microvesicles can be used in the same manner. The resulting aptamers can provide a profile that can differentially detect the cancer vesicles from the normal vesicles. One of skill will appreciate that the same steps can be used to derive an aptamer profile to characterize any disease or condition of interest.

In an embodiment, the invention provides an isolated polynucleotide identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In a related aspect, the invention provides a method of characterizing a biological phenotype using an aptamer profile. The aptamer profile can be determined using the method above. The aptamer profile can be determined for a test sample and compared to a control aptamer profile. The phenotype may be a disease or disorder such as a cancer. Characterizing the phenotype can include without limitation providing a diagnosis, prognosis, or theranosis. Thus, the aptamer profile can provide a diagnostic, prognostic and/or theranostic readout for the subject from whom the test sample is obtained.

In another embodiment, an aptamer profile is determined for a test sample by contacting a pool of aptamer molecules to the test sample, contacting the same pool of aptamers to a control sample, and identifying one or more aptamer molecules that differentially bind a component or target in the test sample but not in the control sample (or vice versa). A "component" or "target" as used in the context of the biological test sample or control sample can be anything that is present in sample to which the aptamers are capable of binding (e.g., polypeptides, peptide, nucleic acid molecules, carbodyhrates, lipids, etc.). For example, if a sample is a plasma or serum sample, the aptamer molecules may bind a polypeptide biomarker that is solely expressed or differentially expressed (over- or underexpressed) in a disease state as compared to a non-diseased subject. Comparison of the aptamer profile in the test sample as compared to the control sample may be based on qualitative and quantitative measure of aptamer binding (e.g., binding versus no binding, or level of binding in test sample versus different level of binding in the reference control sample).

In an aspect, the invention provides a method of identifying a target-specific aptamer profile, comprising contacting a biological test sample with a pool of aptamer molecules, contacting the pool to a control biological sample, identifying one or more aptamers that bind to a component in said test sample but not to the control sample, thereby identifying an aptamer profile for said biological test sample. In an embodiment, a pool of aptamers is selected against a disease sample and compared to a reference sample, the aptamers in a subset that bind to a component(s) in the disease sample but not in the reference sample can be sequenced using conventional sequencing techniques to identify the subset that bind, thereby identifying an aptamer profile for the particular disease sample. In this way, the aptamer profile provides an individualized platform for detecting disease in other samples that are screened. Furthermore, by selecting an appropriate reference or control sample, the aptamer profile can provide a diagnostic, prognostic and/or theranostic readout for the subject from whom the test sample is obtained.

In a related aspect, the invention provides a method of selecting a pool of aptamers, comprising: (a) contacting a biological control sample with a pool of oligonucleotides; (b) isolating a first subset of the pool of oligonucleotides that do not bind the biological control sample; (c) contacting the biological test sample with the first subset of the pool of oligonucleotides; and (d) isolating a second subset of the pool of oligonucleotides that bind the biological test sample, thereby selecting the pool of aptamers. The pool of oligonucleotides may comprise any number of desired sequences, e.g., at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ oligonucleotides may be present in the starting pool. Steps (a)-(d) may be repeated to further hone the pool of aptamers. In an embodiment, these steps are repeated at least 1, 2, 3, 4, 5, 6, 7, 8, 9, 10, 11, 12, 13, 14, 15, 16, 17, 18, 19 or at least 20 times.

As described herein, the biological test sample and biological control sample may comprise microvesicles. In an embodiment, the biological test sample and optionally biological control sample comprise a bodily fluid. The bodily fluid may comprise without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, Cowper's fluid, pre-ejaculatory fluid, female ejaculate, sweat, fecal matter, hair, tears, cyst fluid, pleural fluid, peritoneal fluid, malignant fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids. The biological test sample and optionally biological control may also comprise a tumor sample, e.g., cells from a tumor or tumor tissue. In other embodiments, the biological test sample and optionally biological control sample comprise a cell culture medium. In embodiments, the biological test sample comprises a diseased sample and the biological control sample comprises a non-diseased sample. Accordingly, the pool of aptamers may be used to provide a diagnostic, prognostic and/or theranostic readout a disease.

As noted, the invention can be used to assess microvesicles. Microvesicles are powerful biomarkers because the vesicles provide one biological entity that comprises multiple pieces of information. For example as described, a vesicle can have multiple surface antigens, each of which provides complementary information. Consider a cancer marker and a tissue specific marker. If both markers are individually present in a sample, e.g., both are circulating proteins or nucleic acids, it may not be ascertainable whether the cancer marker and the tissue specific marker are derived from the same anatomical locale. However, if both the cancer marker and the tissue specific marker are surface antigens on a single microvesicle, the vesicle itself links the two markers and provides an indication of a disease (via the cancer marker) and origin of the disease (via the tissue specific marker). Furthermore, the vesicle can have any number of surface antigens and also payload that can be assessed. Accordingly, the invention provides a method for identifying binding agents comprising contacting a plurality of extracellular microvesicles with a randomly generated library of binding agents, identifying a subset of the library of binding agents that have an affinity to one or more components of the extracellular microvesicles. The binding agents may comprise aptamers, antibodies, and/or any other useful type of binding agent disclosed herein or known in the art.

In a related aspect, the invention provides a method for identifying a plurality of target ligands comprising, (a) contacting a reference microvesicle population with a plurality of ligands that are capable of binding one or more microvesicle surface markers, (b) isolating a plurality of reference ligands, wherein the plurality of reference ligands comprise a subset of the plurality of ligands that do not have an affinity for the reference microvesicle population; (c) contacting one or more test microvesicle with the plurality of reference ligands; and (d) identifying a subset of ligands from the the plurality of reference ligands that form complexes with a surface marker on the one or more test microvesicle, thereby identifying the plurality of target ligands. The term "ligand" can refer a molecule, or a molecular group, that binds to another chemical entity to form a larger complex. Accordingly, a binding agent comprises a ligand. The plurality of ligands may comprise aptamers, antibodies and/or other useful binding agents described herein or known in the art.

The invention further provides kits comprising one or more reagent to carry out the methods above. In an embodiment, the one or more reagent comprises a library of potential binding agents that comprises one or more of an aptamer, antibody, and other useful binding agents described herein or known in the art.

Substrate-Sample Complexes

The invention contemplates multiple variations of the method to identify a binding agent that is specific for or binds to a target molecule present in a sample. The binding agent in the context of any of the embodiments herein can be any molecular that is capable of binding to a desired target molecule. Examples of such binding agents are disclosed herein below. Any of the embodiments herein can include a method to identify various types of binding agents that are capable of binding to one or more components present in a biological sample tested. In further embodiments, the specific target to which a binding agent binds or associates is characterized as described above.

In an aspect, the invention provides a method comprising: (a) contacting a substrate with a biological sample to allow formation of a substrate-biological sample complex; (b) contacting the complex with a plurality of candidate binding agents; and (c) identifying one or more binding agent that binds to or associates with the complex, thereby selecting one or more binding agent.

In any of the embodiments herein, the binding agent can be any appropriate binding agent, including those described herein such a nucleic acid, DNA molecule, RNA molecule, antibody, antibody fragment, aptamer, peptoid, zDNA, peptide nucleic acid (PNA), locked nucleic acid (LNA), lectin, peptide, dendrimer, membrane protein labeling agent, chemical compound, or a combination thereof. In an embodiment, the binding agent comprises an antibody, antibody conjugate, antibody fragment, and/or aptamer. In some embodiments, the binding agent comprises a polypeptide, peptide or a nucleic acid molecule. For example, the binding agent can be an aptamer. The polypeptide can be an antibody or functional fragment thereof.

The biological sample may comprise a tissue sample or cell culture sample, a bodily fluid or any component of an animal or human subject that can be isolated for assessment. In any of the embodiments herein, the bodily fluid comprises peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, umbilical cord blood, or a derivative of any thereof. The biological sample of these or other origins may comprise a heterogeneous microvesicle population or a homogeneous microvesicle population.

In some embodiments, the biological sample comprises a concentrated plasma sample, a serum sample, a clarified serum sample, or a clarified plasma sample. The biological sample of these or other origins may comprise a heterogeneous microvesicle population or a homogeneous microvesicle population. As used in the context of microvesicles, the term "heterogenous" means the microvesicle population may comprise microvesicles that are of different cellular or tissue origin, are produced through different biological or cellular mechanisms, and/or comprise microvesicles of different sizes as discussed herein. As used in the context of microvesicles, the term "homogeneous" means without limitation, that the microvesicle population comprise microvesicles that are of the same cellular or tissue origin, are produced through the same biological or cellular mechanisms and/or comprise microvesicles of the same size range as discussed herein. In a non-limiting example, a homogeneous microvesicle population can be obtained from a heterogeneous microvesicle population by subjecting the heterogeneous microvesicle population to affinity isolation or size exclusion methodology.

As used herein, a "clarified" serum or "clarified" plasma sample has reduced levels of one or more abundant protein as compared to an unclarified sample. In such cases, the one or more abundant protein comprises a blood protein. For example, the one or more abundant protein may comprise one or more of albumin, IgG, transferrin, fibrinogen, fibrin, IgA, α2-Marcroglobulin, IgM, α1-Antitrypsin, complement C3, haptoglobulin, apolipoprotein A1, A3 and B; al-Acid Glycoprotein, ceruloplasmin, complement C4, C1q, IgD, prealbumin (transthyretin), plasminogen, a derivative of any thereof, and a combination thereof. The one or more abundant protein may comprise one or more of Albumin, Immunoglobulins, Fibrinogen, Prealbumin, Alpha 1 antitrypsin, Alpha 1 acid glycoprotein, Alpha 1 fetoprotein, Haptoglobin, Alpha 2 macroglobulin, Ceruloplasmin, Transferrin, complement proteins C3 and C4, Beta 2 microglobulin, Beta lipoprotein, Gamma globulin proteins, C-reactive protein (CRP), Lipoproteins (chylomicrons, VLDL, LDL, HDL), other globulins (types alpha, beta and gamma), Prothrombin, Mannose-binding lectin (MBL), a derivative of any thereof, and a combination thereof.

The one or more abundant protein can be depleted using methods known in the art or disclosed herein. For example, abundant proteins can be separated in whole or in part by chromatography methods (size exclusion, ion exchange, immunoaffinity, etc), immunoaffinity, precipitation, or a combination thereof. In some embodiments, selectively depleting the one or more abundant protein comprises contacting the biological sample with thromboplastin. This step can serve to precipitate fibrinogen, thereby facilitating its removal.

The one or more abundant protein is preferably depleted to a level that improves the performance of downstream processing steps. For example, selectively depleting the one or more abundant protein from the biological sample may comprise depleting at least 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99% or 100% of the one or more abundant protein.

The substrate-biological sample complex can comprise a linkage between the substrate and a component of the sample. Any useful method of crosslinking disclosed herein or known in the art can be used. In any of the embodiments herein, the linkage can comprise a cross-link. Any useful method of cross-linking as disclosed herein or known in the art may be used. In an embodiment, the cross-link comprises a photocrosslink, an imidoester crosslinker, dimethyl suberimidate, a lipid crosslinker, an N-Hydroxysuccinimide-ester crosslinker, bissulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl]carbodiimide hydrochloride (EDC or EDAC), Succinimidyl-4-(N-maleimidomethyl)cyclohexane-1-carboxylate (SMCC), a Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithiopropriorate (Sulfo-SBED), 2-[N2-(4-Azido-2,3,5,6-tetrafluorobenzoyl)-N6-(6-biotin-amidocaproyl)-L-lysinyl]ethyl methanethiosulfonate (Mts-Atf-Biotin; available from Thermo Fisher Scientific Inc, Rockford Ill.), 2-{N2-[N6-(4-Azido-2,3,5,6-tetrafluorobenzoyl-6-aminocaproyl)-N6-(6-biotinamidocaproyl)-L-lysinylamido]}ethyl methanethiosultonate (Mts-Atf-LC-Biotin; available from Thermo Fisher Scientific Inc), a photoreactive amino acid (e.g., L-Photo-Leucine and L-Photo-Methionine, see, e.g., Suchanek, M., et al. (2005). Photo-leucine and photo-methionine allow identification of protein-protein interactions. Nat. Methods 2:261-267), an N-Hydroxysuccinimide (NHS) crosslinker, an NHS-Azide reagent (e.g., NHS-Azide, NHS-PEG4-Azide, NHS-PEG12-Azide; each available from Thermo Fisher Scientific, Inc.), an NHS-Phosphine reagent (e.g., NHS-Phosphine, Sulfo-NHS-Phosphine; each available from Thermo Fisher Scientific, Inc.), or any combination or modification thereof.

In any of the embodiments herein, the substrate is directly crosslinked to a sample component, e.g., a microvesicle. Any useful moiety on the surface of the microvesicle can be a target of the linkage, e.g., a surface protein, carbohydrate or lipid moiety. In other embodiments, the substrate is linked to the microvesicle via a linker.

In any of the embodiments herein, the substrate and sample may be linked through a linker that comprises additional components that provide functional linkage, where for example the linker has the same or two different components at each end (e.g., formula of X-linker-X or X-LINKER-Y), wherein "X" and "Y" represent functional moieties that are configured to bind or associate with a substrate and a component present in the biological sample. Thus, it will be evident that in some instances X and Y are the same or different functional moieties. Non-limiting examples of such functional moieties for linking, crosslinking or interchelating with a desired target moiety are disclosed herein. The linker may be a nucleic acid or peptide molecule (e.g., providing an arm that reduces or prevents steric hinderance). The linker may also be a chemical backbone that itself terminates in functional groups that are available for covalent linkage to a specified chemical group present on the selected substrate (e.g. bead) and the selected sample (e.g., microvesicles). The linker can comprise a functionalized lipid. Useful functionalized lipids include without limitation 16:0 Biotinyl PE 1,2-dipalmitoyl-sn-glycero-3-phosphoethanolamine-N-(biotinyl) (sodium salt), 18:1 Biotinyl PE 1,2-dioleoyl-sn-glycero-3-phosphoethanolamine-N-(biotinyl) (sodium salt), 16:0 Biotinyl Cap PE 1,2-dipalmitoyl-sn-glycero-3-phosphoethanolamine-N-(cap biotinyl) (sodium salt) or 18:1 Biotinyl Cap PE 1,2-dioleoyl-sn-glycero-3-phosphoethanolamine-N-(cap biotinyl) (sodium salt), Biotin Sphingosine, Biotin S1P, 12:0 Biotinyl MG, 18:1-12:0 Biotin DG, 12:0 N-Biotinyl Fatty Acid, 18:1-12:0 Biotin PS, 18:1-12:0 Biotin PA, 18:1-12:0 Biotin PE, 18:1-12:0 Biotin PC, 18:1-12:0 Biotin CA, 12:0 Biotinyl LPA, 18:1-12:0 Biotin PIP3, 12:0 Biotinyl Coenzyme A, all of which are available from Avanti Polar Lipids, Inc. (Alabaster, Ala.). The functional lipid may serve as a lipid or membrane anchor.

For illustration, in an X-LINKER-Y example, the X is a moiety capable of binding or associating strongly with substrate (e.g., bead, plate, array) and Y is a moiety of capable of binding to a component of the biological sample such as a cell, microvesicle, etc. X can be a conventional cross-linker, such amine/carbonyl specific compounds as described herein or known in the art. Y can also be a conventional cross-linker, such amine/carbonyl specific compounds as described herein or known in the art. In other embodiments, Y is a lipid-membrane specific moiety. Y may be configured to embed within a lipid membrane of a vesicle, cell or other biological entity.

In addition to the functional lipids described above, other useful membrane anchor entities include without limitation diacyl glycerols, diacyl phosphoglycerols (phospholipids) and sterols, dialkyl glycerols, dialkyl- or diacyl-1-amino-2, 3-dihydroxypropanes, long-chain alkyls or acyls with 8 to 25 carbon atoms, sphingolipids, ceramides, phospholipids, glycosyl phosphatidylinositol (GPI) membrane anchor sequences, glycophospholipid membrane anchors, membrane receptor fragments, protein-binding receptors, metal-chelating receptors, immunoglobulin Fc-binding receptors, cytokine or growth factor-binding receptors, drug-binding receptors, lipid mimicking receptors, transmembrane receptors, synthetic protein-binding receptors, synthetic metal-chelating receptors, synthetic immunoglobulin Fc-binding receptors, synthetic cytokine or growth factor-binding receptors, synthetic drug-binding receptors, synthetic lipid mimicking receptors, synthetic transmembrane receptors, proteins, peptides, peptidomimetics, phospholipids, sphingolipids, steroids, cholesterol, dihydrocholesterol, ergosterol, brassicasterol, cholesterylamine, dihydrocholesterylamine, ergosterylamine, brassicasterylamine, 3-cholesterylamine, 3-dihydrocholesterylamine, 3-ergosterylamine, 3-brassicasterylamine 3β-cholesterylamine, 3-dihydrocholesterylamine, 3β-ergosterylamine, 3β-brassicasterylamine, and derivatives of any thereof. The term "derivative" may be used to refer to a molecule that contains at least the portion of that allows the molecule to insert into a lipid membrane. Examples of derivatives of cholesterol include cholesteryl esters and cholesteryl carbamates. Examples of derivatives of 3β-cholesterylamine include, without limitation, N-alkyl, N-aryl, and N-acyl 3β-cholesterylamines. Still other useful membrane anchoring moieties and methods of use are described in the following references, each of which is incorporated by reference herein in its entirety: Nizard et al., "Anchoring Antibodies to Membranes Using a Diphtheria Toxin T Domain-ZZ Fusion Protein as a pH Sensitive Membrane Anchor," FEBs Letters 433:83-88, 1998; Nizard et al., "Prolonged Display or Rapid Internalization of the IgG-Binding Protein ZZ Anchored to the Surface of Cells Using the Diphtheria Toxin T Domain," Protein Engineering 14(6):439-446, 2001; Caras et al., "Signal peptide for protein secretion directing glycophospholipid membrane anchor attachment", Science, vol. 243:1196-1198 (1989); Lin et al., "Expression of T Cell Antigen Receptor Heterodimers in a Lipid-Linked Form," Science Reports, 1990; 249:677-679; Hussey, Stephen L., et al., "A Synthetic Membrane-Anchored Antigen Efficiently Promotes Uptake of Antifluorescein Antibodies and Associated Protein a by Mammalian Cells", J. Am. Chem. Soc., 2001, vol. 123, pp. 12712-12713; U.S. Patent Application 2006/0068388 A1; U.S. Pat. Nos. 7,083,958, 7,160,856, 7,288,368, 7,371,404, 7,407,947, 7,514,400, 7,611,863, 7,858,117, 7,947,647, 8,013,131, 8,048,448, 8,088,601, 8,198,230; PCT Patent Applications PCT/US98/15124 (WO 99/05255), WO 00/59474, PCT/NZ02/00214 (WO 03/034074), PCT/NZ03/00059 (WO 03/087346).

The invention further comprises identification of the binding agent identified by the method herein. Methods of identifying biological entities are known in the art. For example, nucleic acids can be identified by sequencing (Sanger, NextGen, etc).

In another aspect, the invention provides a composition of matter comprising a substrate-microvesicle complex, wherein the substrate is synthetic. As used in the context of a substrate-microvesicle complex, the term "synthetic" means that the substrate is man-made. The substrate can be a bead (e.g., a magnetic bead, a polystyrene bead, etc.), a planar substrate, or other useful substrate disclosed herein or known in the art. The composition can be used in the methods above to identify binding agents. The composition can also be used to provide normalization in an assay comprising a substrate. As a non-limiting example, a bead linked to a microvesicle can be used to provide normalization in an assay wherein microvesicles in a biological sample are captured and detected using beads.

In an embodiment, the sample comprises a microvesicle bound to a substate. The method can then be used to identify aptamers and/or other binding agents that bind a microvesicle, including without limitation a microvesicle surface antigen. Microvesicles can be bound to a substrate using various methods, e.g.: 1) direct conjugation; 2) lipid anchoring; 3) antibody binding; and 4) aptamer binding. See schematics in FIGS. 7A-D. FIG. 7A illustrates direct conjugation of a carboxylated microsphere to a vesicle surface antigen. FIG. 7B illustrates anchoring of a microvesicle to a microsphere via a biotin functionalized lipid anchor. FIG. 7C illustrates antibody binding to a vesicle surface antigen, wherein the antibody is conjugated to a carboxylated microsphere. FIG. 7D illustrates aptamer binding to a vesicle surface antigen, wherein the aptamer is conjugated to a carboxylated microsphere. Substrate attached microvesicles produced by the method can be used to screen an aptamer library against the microvesicle as described herein. FIGS. 8-10 illustrate use of microvesicle-substrate complexes to screen aptamer libraries. FIGS. 11-12 present images of microbead-conjugated microvesicles.

In an aspect, the invention provides a method of producing a stable substrate-microvesicle complex, comprising contacting a substrate with a microvesicle, wherein the substrate is functionalized with a chemical group capable of binding directly to at least one component present on the surface of the microvesicle. The substrate may be a bead, a well, a matrix, e.g., a gel matrix in a column, or a planar substrate. The chemical group can comprise any useful chemical group that can link a microvesicle to a bead, such as those described above. For example, the chemical group may comprise without limitation a peptoid, zDNA, peptide nucleic acid (PNA), locked nucleic acid (LNA), lectin, peptide/polypeptide, dendrimer, membrane protein labeling agent, chemical compound, a photocrosslink, an imidoester crosslinker, dimethyl suberimidate, a lipid crosslinker, an N-Hydroxysuccinimide-ester crosslinker, bissulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl]carbodiimide hydrochloride (EDC or EDAC), Succinimidyl-4-(N-maleimidomethyl)cyclohexane-1-carboxylate (SMCC), a Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithioproprionate (Sulfo-SBED), 2-[N2-(4-Azido-2,3,5,6-tetrafluorobenzoyl)-N6-(6-biotin-amido-caproyl)-L-lysinyl]ethyl methanethiosulfonate (Mts-Atf-Biotin; available from Thermo Fisher Scientific Inc, Rockford Ill.), 2-{N2-[N6-(4-Azido-2,3,5,6-tetrafluorobenzoyl-6-amino-caproyl)-N6-(6-biotinamidocaproyl)-L-lysinylamido]}ethyl methanethiosultonate (Mts-Atf-LC-Biotin; available from Thermo Fisher Scientific Inc), a photoreactive amino acid (e.g., L-Photo-Leucine and L-Photo-Methionine, see, e.g., Suchanek, M., et al. (2005). Photo-leucine and photo-methionine allow identification of protein-protein interactions. Nat. Methods 2:261-267), an N-Hydroxysuccinimide (NHS) crosslinker, an NHS-Azide reagent (e.g., NHS-Azide, NHS-PEG4-Azide, NHS-PEG12-Azide; each available from Thermo Fisher Scientific, Inc.), an NHS-Phosphine reagent (e.g., NHS-Phosphine, Sulfo-NHS-Phosphine; each available from Thermo Fisher Scientific, Inc.), or a combination thereof. The chemical group may not include antibodies or aptamers. The chemical group may comprise a functional group such as disclosed herein, including without limitation a hydrocarbon, a halogen, a group containing oxygen (i.e., C—O bonds), a group containing nitrogen, a group containing sulfur, a group containing phosphorus, a group containing boron, a carboxyl group, an amino group, a hydroxyl group, a hydrazide group, a chloromethyl group, or a combination thereof. The at least one component may comprise any useful biological component such as disclosed herein, including without limitation a peptide, polypeptide, protein, lipid, carbohydrate, a derivative thereof, or a combination thereof.

Figure 10A:
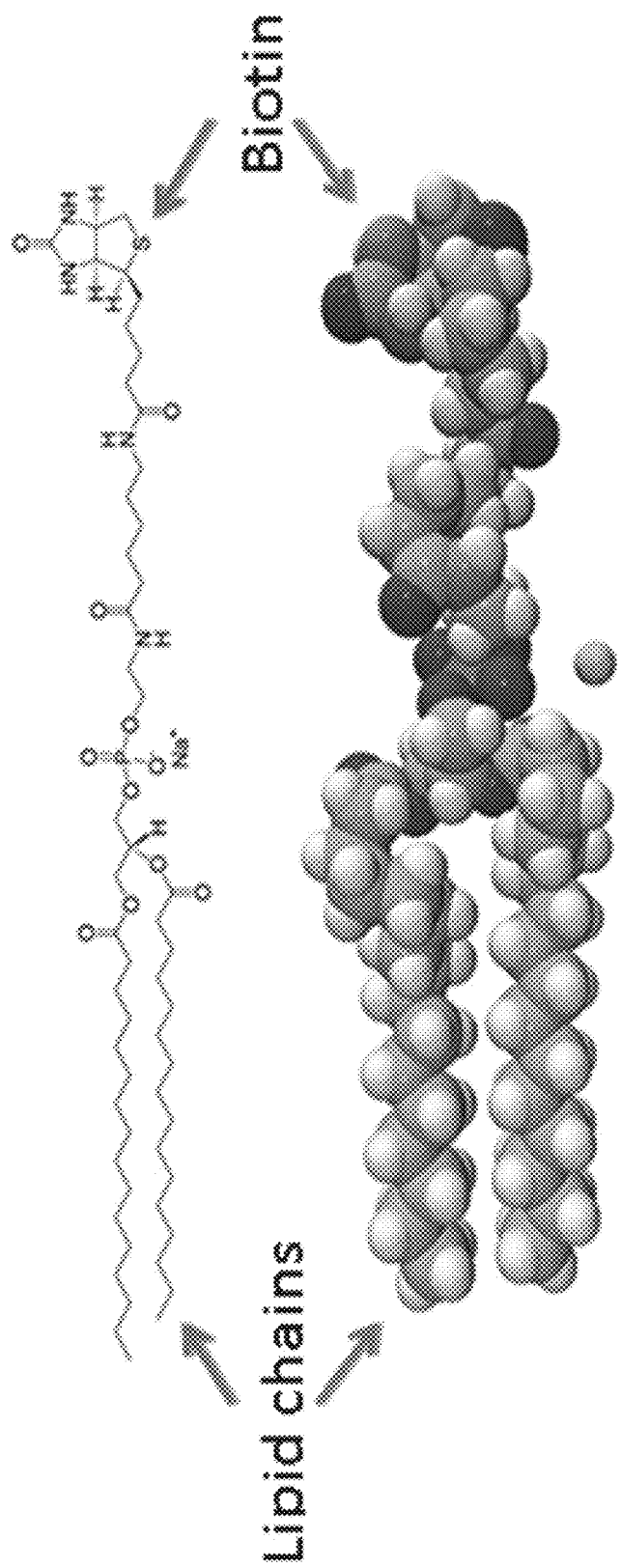
Figure 10B:
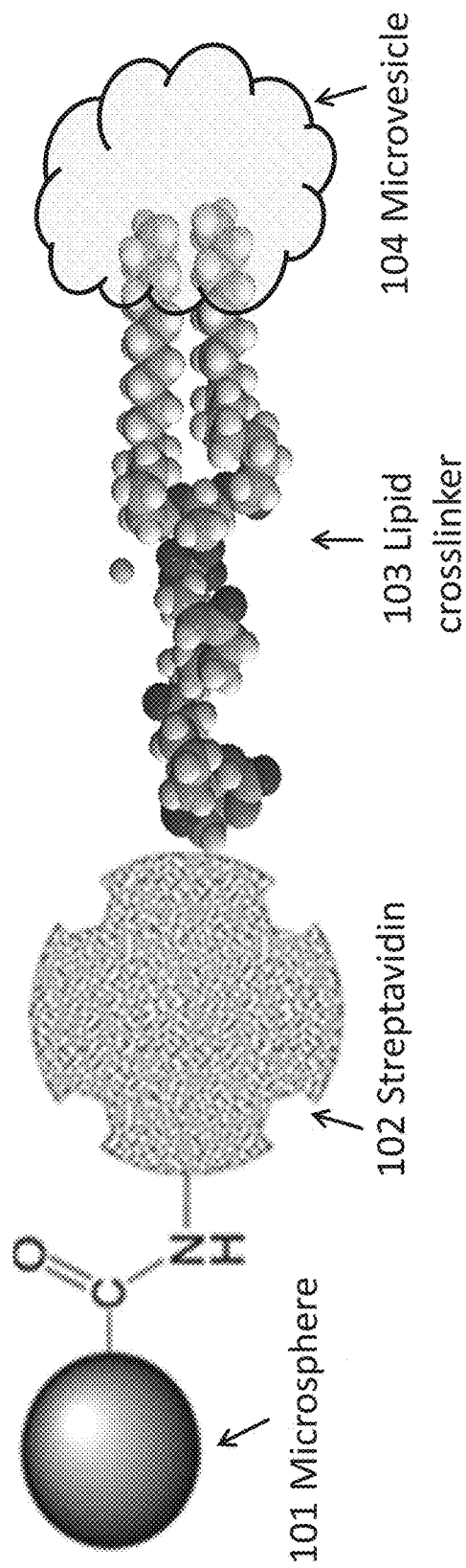
FIG. 10B illustrates biotin functionalized lipid anchoring of microvesicles to the microspheres. As shown, a carboxylated microsphere 101 is conjugated to streptavidin 102. The crosslinker 103 is bound to the streptavidin via a biotin moiety (see FIG. 10A). Finally, the lipid linker 103 is embedded in the lipid bilayer membrane of the microvesicle 104.

In a related aspect, the invention provides a method of isolating a microvesicle from a sample comprising, contacting a biological sample to a substrate disposed with a lipid moiety that is capable of forming a complex with a microvesicle, partitioning any complex formed from the sample, thereby isolating the microvesicle. The invention also provides an isolated complex comprising a synthetic substrate directly bound to a lipid moiety that is complexed to a microvesicle such as in FIG. 10B. One aspect of the invention is incorporation of a lipid moiety (also referred to as "lipid anchor" into a fixed substrate, such as a planar sheet or sphere which is then utilized as a reagent to separate or isolate a microvesicle from a source biological sample (FIG. 10B). The substrate is bound to the lipid anchor through direct covalent linkage (such as through a amide linkage) or the lipid anchor is functionalized to bind to the substrate indirectly, such as by using streptavidin or avidin (FIG. 10B). The biological sample used in methods of the invention can be any biological liquid from a subject or from cell culture, including but not limited to blood, plasma, serum, cell culture media (whether crude or clarified). Examples of lipid anchors that can be incorporated into practicing methods of the invention or manufacture of compositions of the invention include those disclosed herein or in United States Patent Application Publications having the following reference numbers: 2013/0035371, 2012/0264810, 2012/0101148, 2012/0027803; or U.S. Pat. No. 6,986,902, the specification for each of which is incorporated herein by reference in its entirety.

The invention further provides kits comprising one or more reagent to carry out the methods above. In an embodiment, the one or more reagent comprises a library of potential binding agents that comprises one or more of an aptamer, antibody, and other useful binding agents described herein or known in the art. In another embodiment, the one or more reagent comprises an aptamer identified by the methods above. In still another embodiment, the one or more reagent comprises a substrate-microvesicle complex and/or a reagent that is part of such complex, e.g., a linker or cross linker as described herein. The kit may comprise components disclosed herein useful for forming microvesicle-substrate complexes by various methods, e.g., via direct conjugation, lipid anchoring, antibody binding, and/or aptamer binding.

Negative and Positive Aptamer Selection

Aptamers can be used in various biological assays, including numerous types of assays which rely on a binding agent. For example, aptamers can be used instead of or alongside antibodies in immune-based assays. The invention provides an aptamer screening method that identifies aptamers that do not bind to any surfaces (substrates, tubes, filters, beads, other antigens, etc.) throughout the assay steps and bind specifically to an antigen of interest. The assay relies on negative selection to remove aptamers that bind non-target antigen components of the final assay. The negative selection is followed by positive selection to identify aptamers that bind the desired antigen.

In an aspect, the invention provides a method of identifying an aptamer specific to a target of interest, comprising (a) contacting a pool of candidate aptamers with one or more assay components, wherein the assay components do not comprise the target of interest; (b) recovering the members of the pool of candidate aptamers that do not bind to the one or more assay components in (a); (c) contacting the members of the pool of candidate aptamers recovered in (b) with the target of interest in the presence of one or more confounding target; and (d) recovering a candidate aptamer that binds to the target of interest in step (c), thereby identifying the aptamer specific to the target of interest. In the method, steps (a) and (b) provide negative selection to remove aptamers that bind non-target entities. Conversely, steps (c) and (d) provide positive selection by identifying aptamers that bind the target of interest but not other confounding targets, e.g., other antigens that may be present in a biological sample which comprises the target of interest. The pool of candidate aptamers may comprise at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ nucleic acid sequences. One means of performing the method is illustrated in detail in Example 9.

In some embodiments, steps (a)-(b) are optional. In other embodiments, steps (a)-(b) are repeated at least 1, 2, 3, 4, 5, 6, 7, 8, 9, 10, 11, 12, 13, 14, 15, 16, 17, 18, 19 or at least 20 times before positive selection in step (c) is performed. The positive selection can also be performed in multiple rounds. Steps (c)-(d) can be repeated at least 1, 2, 3, 4, 5, 6, 7, 8, 9, 10, 11, 12, 13, 14, 15, 16, 17, 18, 19 or at least 20 times before identifying the aptamer specific to the target of interest. Multiple rounds may provide improved stringency of selection.

In some embodiments, the one or more assay components contacted with the aptamer pool during negative selection comprise one or more of a substrate, a bead, a planar array, a column, a tube, a well, or a filter. One of skill will appreciate that the assay components can include any substance that may be part of a biological assay.

The target of interest can be any appropriate entity that can be detected when recognized by an aptamer. In an embodiment, the target of interest comprises a protein or polypeptide. As used herein, "protein," "polypeptide" and "peptide" are used interchangeably unless stated otherwise. The target of interest can be a nucleic acid, including DNA, RNA, and various subspecies of any thereof as disclosed herein or known in the art. The target of interest can comprise a lipid. The target of interest can comprise a carbohydrate. The target of interest can also be a complex, e.g., a complex comprising protein, nucleic acids, lipids and/or carbohydrates. In some embodiments, the target of interest comprises a microvesicle. In such cases, the aptamer can be a binding agent to a microvesicle surface antigen, e.g., a protein. General microvesicle surface antigens include tetraspanin, CD9, CD63, CD81, CD63, CD9, CD81, CD82, CD37, CD53, Rab-5b, Annexin V, and MFG-E8. Additional general microvesicle surface antigens are provided in Table 3 herein.

The microvesicle surface antigen can also be a biomarker of a disease or disorder. In such cases, the aptamer may be used to provide a diagnosis, prognosis or theranosis of the disease or disorder. For example, the one or more protein may comprise one or more of PSMA, PCSA, B7H3, EpCam, ADAM-10, BCNP, EGFR, IL1B, KLK2, MMP7, p53, PBP, SERPINB3, SPDEF, SSX2, and SSX4. These markers can be used detect a prostate cancer. Additional microvesicle surface antigens are provided in Tables 3-4 herein.

The one or more confounding target can be an antigen other than the target of interest. For example, a confounding target can be another entity that may be present in a sample to be assayed. As a non-limiting example, consider that the sample to be assessed is a plasma sample from an individual. The target of interest may be a protein, e.g., a microvesicle surface antigen, which is present in the sample. In this case, a confounding target could be selected from any other antigen that is likely to be present in the plasma sample. Accordingly, the positive selection should provide candidate aptamers that recognize the target of interest but have minimal, if any, interactions with the confounding targets. In some embodiments, the target of interest and the one or more confounding target comprise the same type of biological entity, e.g., all protein, all nucleic acid, all carbohydrate, or all lipids. As a non-limiting example, the target of interest can be a protein selected from the group consisting of SSX4, SSX2, PBP, KLK2, SPDEF, and EpCAM, and the one or more confounding target comprises the other members of this group. In other embodiments, the target of interest and the one or more confounding target comprise different types of biological entities, e.g., any combination of protein, nucleic acid, carbohydrate, and lipids. The one or more confounding targets may also comprise different types of biological entities, e.g., any combination of protein, nucleic acid, carbohydrate, and lipids.

In an embodiment, the invention provides an isolated polynucleotide, or a fragment thereof, identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In a related aspect, the invention provides a method of selecting a group of aptamers, comprising: (a) contacting a pool of aptamers to a population of microvesicles from a first sample; (b) enriching a subpool of aptamers that show affinity to the population of microvesicles from the first sample; (c) contacting the subpool to a second population of microvesicles from a second sample; and (d) depleting a second subpool of aptamers that show affinity to the second population of microvesicles from the second sample, thereby selecting the group of aptamers that have preferential affinity for the population of microvesicles from the first sample.

The first sample and/or second sample may comprise a biological fluid such as disclosed herein. For example, the biological fluid may include without limitation blood, a blood derivative, plasma, serum or urine. The first sample and/or second sample may also be derived from a cell culture.

In an embodiment, the first sample comprises a cancer sample and the second sample comprises a control sample, such as a non-cancer sample. The first sample and/or and the second sample may each comprise a pooled sample. For example, the first sample and/or second sample can comprise bodily fluid from 2, 3, 4, 5, 6, 7, 8, 9, 10, 11, 12, 13, 14, 15, 16, 17, 18, 19, 20, 25, 30, 40, 50, 60, 70, 80, 90, 100 or more than 100 individuals. In such cases, the members of a pool may be chosen to represent a desired phenotype. In a non-limiting example, the members of the first sample pool may be from patients with a cancer and the members of the second sample pool may be from non-cancer controls.

Steps (a)-(d) can be repeated a desired number of times in order to further enrich the pool in aptamers that have preferential affinity for the population of microvesicles from the first sample. For example, steps (a)-(d) can be repeated 1, 2, 3, 4, 5, 6, 7, 8, 9, 10, 11, 12, 13, 14, 15, 16, 17, 18, 19, 20 or more than 20 times. The output from step (d) can be used as the input to repeated step (a). In embodiment, the first sample and/or second sample are replaced with a different sample before repeating steps (a)-(d). In a non-limiting example, members of a first sample pool may be from patients with a cancer and members of a second sample pool may be from non-cancer controls. During subsequent repetitions of steps (a)-(d), the first sample pool may comprise samples from different cancer patients than in the prior round/s. Similarly, the second sample pool may comprise samples from different controls than in the prior round/s.

The method may further comprise identifying the members of the selected group of aptamers, e.g., by DNA sequencing. The sequencing may be performed by Next Generation sequencing as desired.

The method may also comprise identifying the targets of the selected group of aptamers. Methods to identify aptamer targets are disclosed herein.

Figure 13A:
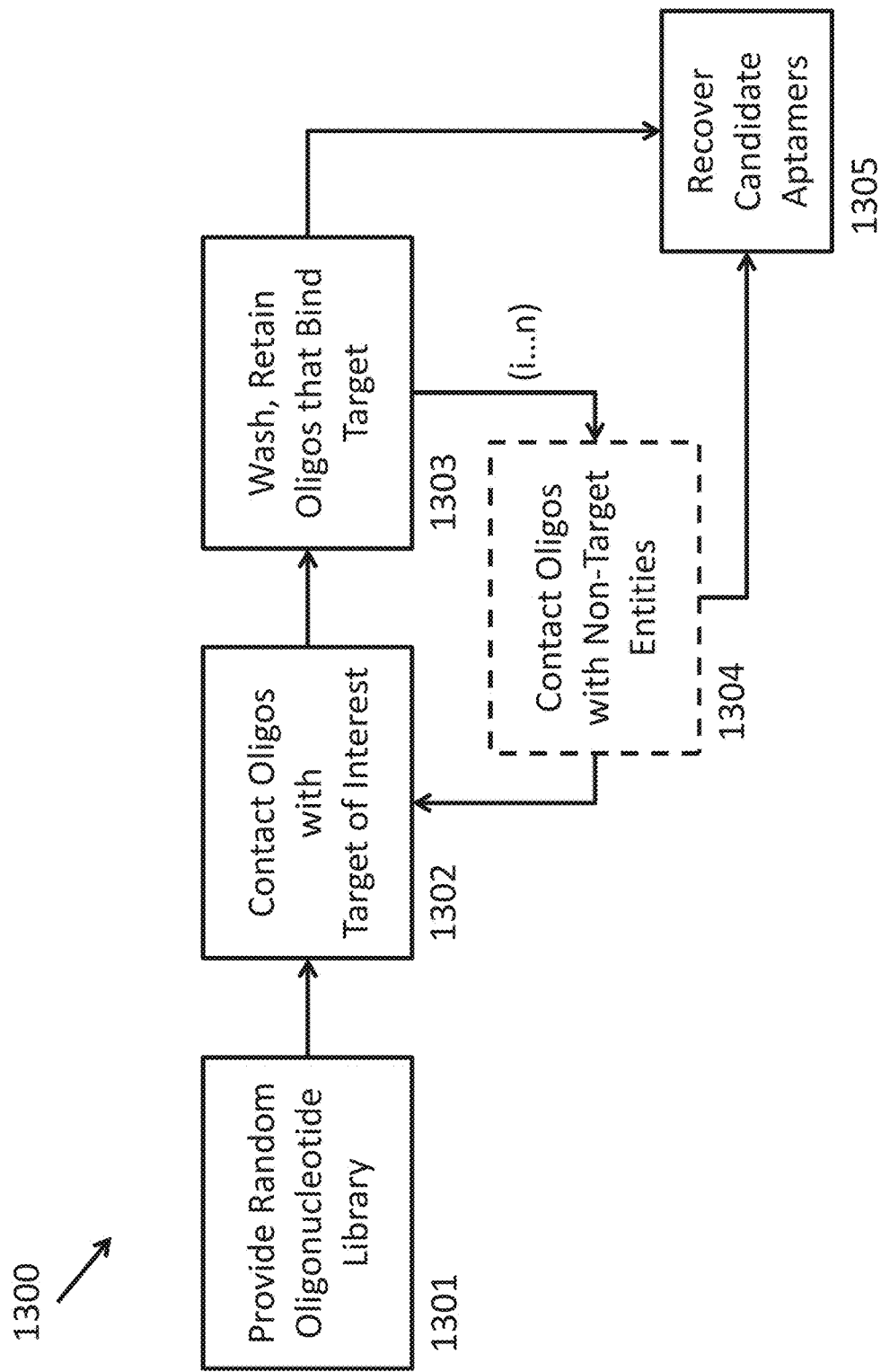

FIG. 13A illustrates a scheme 1300 for positive and optionally negative rounds of screening an oligonucleotide library against a target of interest. A library pool of oligo candidates is provided 1301. The pool of oligo candidate aptamers may comprise any number of desired members, e.g., at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ nucleic acid sequences. To perform positive selection, the oligos are contacted with the target of interest 1302. The target of interest can be any appropriate entity that can be detected when recognized by an aptamer. The target of interest may comprise a protein or polypeptide, a nucleic acid, including DNA, RNA, and various subspecies thereof, a lipid, a carbohydrate, a complex, e.g., a complex comprising protein, nucleic acids, lipids and/or carbohydrates. In some embodiments, the target of interest comprises a microvesicle. The target may be immobilized to a substrate using methods disclosed herein (see, e.g., Examples 28-31) or known in the art. The mixture is washed to remove unbound oligos and then oligos are disassociated from the washed mixture and collected 1303. The collected oligos can be used as input to a new round of target binding, which can be repeated any number of times (indicated as 1 . . . n). For example, positive selection can be repeated 1, 2, 3, 4, 5, 6, 7, 8, 9, 10, 11, 12, 13, 14, 15, 16, 17, 18, 19, 20 or more than 20 times. Between rounds of positive selection, negative selection is optionally performed wherein oligos are contacted with one or more non-target entity 1304. The non-target entity can be any entity that may interfere with specific binding of the resulting aptamers to the target of interest, including without limitation other biological entities, non-disease specific targets, and various assay components (substrates, tubes, etc.). During negative selection, oligos that do not bind the one or more non-target entity are retained and used as input to a new round of positive selection 1302. This step serves to remove oligos that have an affinity for the non-target entities. The oligos collected after the desired numbers of rounds of positive selection 1303 and/or negative selection 1304 are collected as candidate aptamers which are indicated to bind the target of interest 1305.

FIG. 13B illustrates one such scheme for selection of aptamers against cancer samples versus non-cancer control samples. The scheme shows 8 cancer samples (Ca1-Ca8) and 7 control samples (nCa1-nCa7) each consisting of individual samples or pooled samples. Seven different selections (Selection 1-Selection 7) are run in parallel. In each Selection, an input pool of candidate aptamers is enriched for aptamers against one of the cancer samples ("positive selection"), and then the pool is depleted of aptamers against one of the control samples ("negative selection"). This process is repeated as indicated. The ordering of the samples is altered in each Selection to avoid selection bias. The aptamers remaining after the last round of positive selection comprise the selected aptamers, which can then be further developed, e.g., as part of an assay to differentiate cancer from non-cancer samples. The aptamer pools can be sequenced after each round to track enrichment, depletion, potential issues, etc.

Aptamer Target Identification

The methods and kits above can be used to identify binding agents that differentiate between two biomarker populations. The invention further provides methods of identifying the targets of the binding agents, as described in this section. For example, the methods may further comprise identifying a surface marker of a target microvesicle that is recognized by the binding agent.

In an embodiment, the invention provides a method of identifying a target of a binding agent comprising: (a) contacting the binding agent with the target to bind the target with the binding agent, wherein the target comprises a surface antigen of a microvesicle; (b) disrupting the microvesicle under conditions which do not disrupt the binding of the target with the binding agent; (c) isolating the complex between the target and the binding agent; and (d) identifying the target bound by the binding agent. The binding agent can be a binding agent identified by the methods above, e.g., an aptamer, ligand, antibody, or other useful binding agent that can differentiate between two populations of biomarkers.

Figure 14:
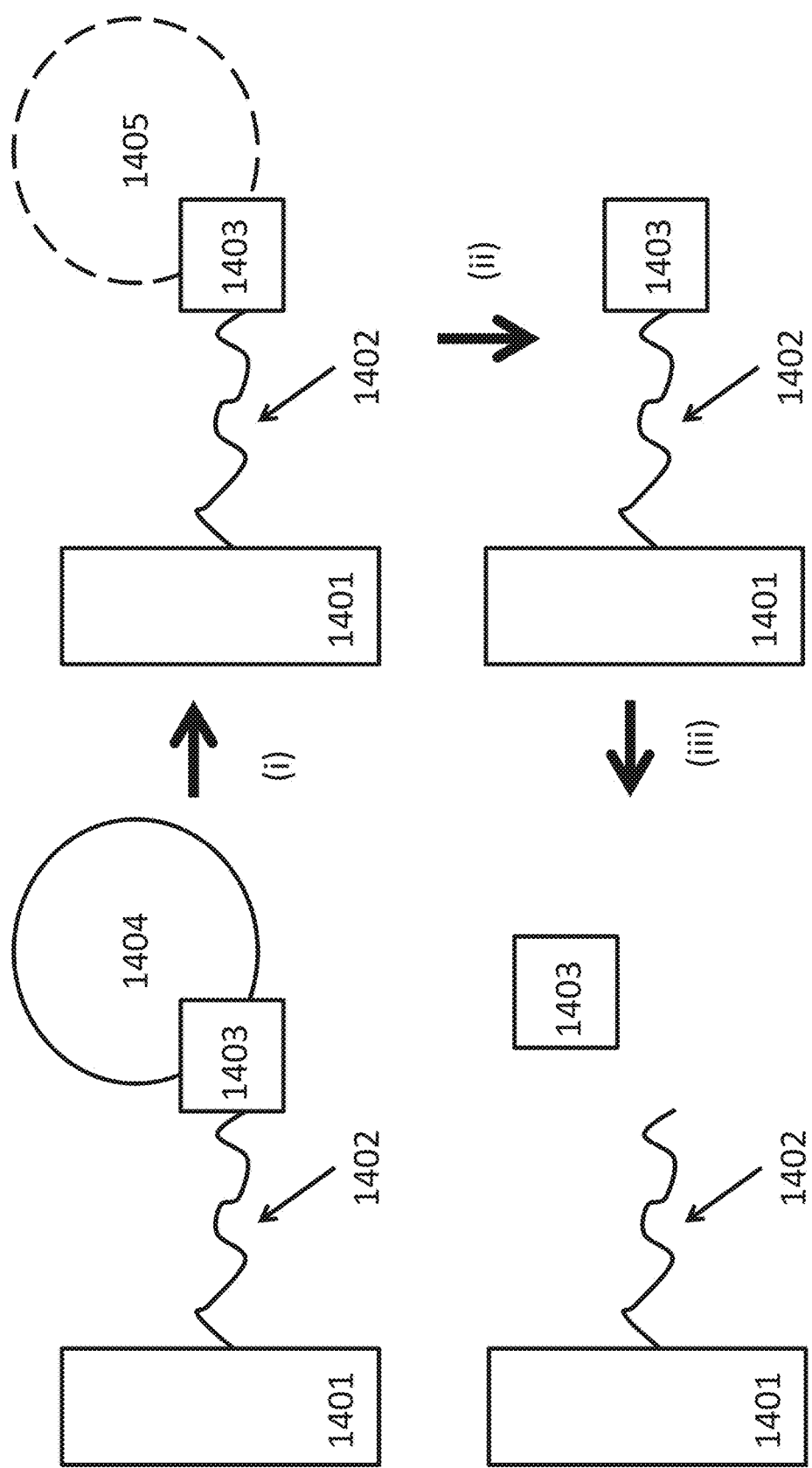
FIG. 14 comprises a schematic for identifying a target of a selected aptamer, such as an aptamer selected by the above process. The figure shows a binding agent 1402, here an aptamer for purposes of illustration, tethered to a substrate 1401. The binding agent 1402 can be covalently attached to substrate 1401. The binding agent 1402 may also be non-covalently attached. For example, binding agent 1402 can comprise a label which can be attracted to the substrate, such as a biotin group which can form a complex with an avidin/streptavidin molecule that is covalently attached to the substrate. The binding agent 1402 binds to a surface antigen 1403 of microvesicle 1404. In the step signified by arrow (i), the microvesicle is disrupted while leaving the complex between the binding agent 1402 and surface antigen 1403 intact. Disrupted microvesicle 1405 is removed, e.g., via washing or buffer exchange, in the step signified by arrow (ii). In the step signified by arrow (iii), the surface antigen 1403 is released from the binding agent 1402. The surface antigen 1403 can be analyzed to determine its identity.

An illustrative schematic for carrying on the method is shown in FIG. 14. The figure shows a binding agent 1402, here an aptamer for purposes of illustration, tethered to a substrate 1401. The binding agent 1402 can be covalently attached to substrate 1401. The binding agent 1402 may also be non-covalently attached. For example, binding agent 1402 can comprise a label which can be attracted to the substrate, such as a biotin group which can form a complex with an avidin/streptavidin molecule that is covalently attached to the substrate. This can allow a complex to be formed between the aptamer and the microvesicle while in solution, followed by capture of the aptamer using the biotin label. The binding agent 1402 binds to a surface antigen 1403 of microvesicle 1404. In the step signified by arrow (i), the microvesicle is disrupted while leaving the complex between the binding agent 1402 and surface antigen 1403 intact. Disrupted microvesicle 1405 is removed, e.g., via washing or buffer exchange, in the step signified by arrow (ii). In the step signified by arrow (iii), the surface antigen 1403 is released from the binding agent 1402. The surface antigen 1403 can be analyzed to determine its identity using methods disclosed herein and/or known in the art. The target of the method can be any useful biological entity associated with a microvesicle. For example, the target may comprise a protein, nucleic acid, lipid or carbohydrate, or other biological entity disclosed herein or known in the art.

In some embodiments of the method, the target is cross-linked to the binding agent prior disrupting the microvesicle. Without being bound by theory, this step may assist in maintaining the complex between the binding agent and the target while the vesicle is disrupted. Any useful method of crosslinking disclosed herein or known in the art can be used. In embodiments, the cross-linking comprises photo-crosslinking, an imidoester crosslinker, dimethyl suberimidate, an N-Hydroxysuccinimide-ester crosslinker, bissulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl] carbodiimide hydrochloride (EDC or EDAC), Succinimidyl-4-(N-maleimidomethyl)cyclohexane-1-carboxylate (SMCC), a Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithioproprionate (Sulfo-SBED), 2-[N2-(4-Azido-2,3,5,6-tetrafluorobenzoyl)-N6-(6-biotin-amidocaproyl)-L-lysinyl]ethyl methanethiosulfonate (Mts-Atf-Biotin; available from Thermo Fisher Scientific Inc, Rockford Ill.), 2-{N2-[N6-(4-Azido-2,3,5,6-tetrafluorobenzoyl-6-amino-caproyl)-N6-(6-biotinamidocaproyl)-L-lysinylamido]}ethyl methanethiosultonate (Mts-Atf-LC-Biotin; available from Thermo Fisher Scientific Inc), a photoreactive amino acid (e.g., L-Photo-Leucine and L-Photo-Methionine, see, e.g., Suchanek, M., et al. (2005). Photo-leucine and photo-methionine allow identification of protein-protein interactions. Nat. Methods 2:261-267), an N-Hydroxysuccinimide (NHS) crosslinker, an NHS-Azide reagent (e.g., NHS-Azide, NHS-PEG4-Azide, NHS-PEG12-Azide; each available from Thermo Fisher Scientific, Inc.), an NHS-Phosphine reagent (e.g., NHS-Phosphine, Sulfo-NHS-Phosphine; each available from Thermo Fisher Scientific, Inc.), or any combination or modification thereof.

A variety of methods can be used to disrupt the microvesicle. For example, the vesicle membrane can be disrupted using mechanical forces, chemical agents, or a combination thereof. In embodiments, disrupting the microvesicle comprises use of one or more of a detergent, a surfactant, a solvent, an enzyme, or any useful combination thereof. The enzyme may comprise one or more of lysozyme, lysostaphin, zymolase, cellulase, mutanolysin, a glycanase, a protease, and mannase. The detergent or surfactant may comprise one or more of a octylthioglucoside (OTG), octyl beta-glucoside (OG), a nonionic detergent, Triton X, Tween 20, a fatty alcohol, a cetyl alcohol, a stearyl alcohol, cetostearyl alcohol, an oleyl alcohol, a polyoxyethylene glycol alkyl ether (Brij), octaethylene glycol monododecyl ether, pentaethylene glycol monododecyl ether, a polyoxypropylene glycol alkyl ether, a glucoside alkyl ether, decyl glucoside, lauryl glucoside, octyl glucoside, a polyoxyethylene glycol octylphenol ethers, a polyoxyethylene glycol alkylphenol ether, nonoxynol-9, a glycerol alkyl ester, glyceryl laurate, a polyoxyethylene glycol sorbitan alkyl esters, polysorbate, a sorbitan alkyl ester, cocamide MEA, cocamide DEA, dodecyldimethylamine oxide, a block copolymers of polyethylene glycol and polypropylene glycol, poloxamers, polyethoxylated tallow amine (POEA), a zwitterionic detergent, 3-[(3-cholamidopropyl)dimethylammonio]-1-propanesulfonate (CHAPS), a linear alkylbenzene sulfonate (LAS), a alkyl phenol ethoxylate (APE), cocamidopropyl hydroxysultaine, a betaine, cocamidopropyl betaine, lecithin, an ionic detergent, sodium dodecyl sulfate (SDS), cetrimonium bromide (CTAB), cetyl trimethylammonium chloride (CTAC), octenidine dihydrochloride, cetylpyridinium chloride (CPC), benzalkonium chloride (BAC), benzethonium chloride (BZT), 5-Bromo-5-nitro-1,3-dioxane, dimethyldioctadecylammonium chloride, dioctadecyldimethylammonium bromide (DODAB), sodium deoxycholate, nonyl phenoxypolyethoxylethanol (Tergitol-type NP-40; NP-40), ammonium lauryl sulfate, sodium laureth sulfate (sodium lauryl ether sulfate (SLES)), sodium myreth sulfate, an alkyl carboxylate, sodium stearate, sodium lauroyl sarcosinate, a carboxylate-based fluorosurfactant, perfluorononanoate, perfluorooctanoate (PFOA or PFO), and a biosurfactant. Mechanical methods of disruption that can be used comprise without limitation mechanical shear, bead milling, homogenation, microfluidization, sonication, French Press, impingement, a colloid mill, decompression, osmotic shock, thermolysis, freeze-thaw, desiccation, or any combination thereof.

As shown in FIG. 14, the binding agent may be tethered to a substrate. The binding agent can be tethered before or after the complex between the binding agent and target is formed. The substrate can be any useful substrate such as disclosed herein or known in the art. In an embodiment, the substrate comprises a microsphere. In another embodiment, the substrate comprises a planar substrate. The binding agent can also be labeled. Isolating the complex between the target and the binding agent may comprise capturing the binding agent via the label. For example, the label can be a biotin label. In such cases, the binding agent can be attached to the substrate via a biotin-avidin binding event.

Methods of identifying the target after release from the binding agent will depend on the type of target of interest. For example, when the target comprises a protein, identifying the target may comprise use of mass spectrometry (MS), peptide mass fingerprinting (PMF; protein fingerprinting), sequencing, N-terminal amino acid analysis, C-terminal amino acid analysis, Edman degradation, chromatography, electrophoresis, two-dimensional gel electrophoresis (2D gel), antibody array, and immunoassay. Nucleic acids can be identified by sequencing.

One of skill will appreciate that the method can be used to identify any appropriate target, including those not associated with a vesicle. For example, with respect to the FIG. 14, all steps except for the step signified by arrow (i) (i.e., disrupting the microvesicle), could be performed for a circulating target such as a protein, nucleic acid, lipid, carbohydrate, or combination thereof.

Sample Characterization

The aptamers of the invention can be used to characterize a biological sample. For example, an aptamer can be used to bind a biomarker in the sample. The presence or level of the bound biomarker can indicate a characteristic of the example, such as a diagnosis, prognosis or theranosis of a disease or disorder associated with the sample.

In an aspect, the invention provides a method of characterizing a disease or disorder, comprising: (a) contacting a biological test sample with one or more aptamer of the invention; (b) detecting a presence or level of a complex between the one or more aptamer and the target bound by the one or more aptamer in the biological test sample formed in step (a); (c) contacting a biological control sample with the one or more aptamer; (d) detecting a presence or level of a complex between the one or more aptamer and the target bound by the one or more aptamer in the biological control sample formed in step (c); and (e) comparing the presence or level detected in steps (b) and (d), thereby characterizing the disease or disorder. The one or more aptamer can comprise any aptamer useful for characterizing the disease or disorder, e.g., the aptamers comprising any of SEQ ID NOs. 1-241535 herein, a useful modification, or a functional fragment thereof.

The biological test sample and biological control sample can each comprise a tissue sample, a cell culture, or a biological fluid. In some embodiments, the biological test sample and biological control sample comprise the same sample type, e.g., both are tissue samples or both are fluid samples. In other embodiments, different sample types may be used for the test and control samples. For example, the control sample may comprise an engineered or otherwise artificial sample.

The biological fluid may comprise a bodily fluid. The bodily fluid may include without limitation one or more of peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In some embodiments, the bodily fluid comprises blood, serum or plasma.

The biological fluid may comprise microvesicles. For example, the biological fluid can be a tissue, cell culture, or bodily fluid which comprises microvesicles released from cells in the sample. The microvesicles can be circulating microvesicles.

The one or more aptamer can bind a target biomarker, e.g., a biomarker useful in characterizing the sample. The biomarker may comprise a polypeptide or fragment thereof, or other useful biomarker described herein or known in the art (lipid, carbohydrate, complex, nucleic acid, etc). In embodiments, the polypeptide or fragment thereof is soluble or membrane bound. Membrane bound polypeptides may comprise a cellular surface antigen or a microvesicle surface antigen. The biomarker can be a biomarker selected from Table 3 or Table 4.

The characterizing can comprises a diagnosis, prognosis or theranosis of the disease or disorder. Various diseases and disorders can be characterized using the compositions and methods of the invention, including without limitation a cancer, a premalignant condition, an inflammatory disease, an immune disease, an autoimmune disease or disorder, a cardiovascular disease or disorder, a neurological disease or disorder, an infectious disease, and/or pain. See section herein "Phenotypes" for further details. In embodiments, the disease or disorder comprises a proliferative or neoplastic disease or disorder. For example, the disease or disorder can be a cancer. In some embodiments, the cancer comprises a breast cancer, ovarian cancer, prostate cancer, lung cancer, colorectal cancer, melanoma, or brain cancer.

FIG. 15A is a schematic 1500 showing an assay configuration that can be used to detect and/or quantify a target of interest using one or more aptamer of the invention. Capture aptamer 1502 is attached to substrate 1501. The substrate can be a planar substrate, well, microbead, or other useful substrate as disclosed herein or known in the art. Target of interest 1503 is bound by capture aptamer 1502. The target of interest can be any appropriate entity that can be detected when recognized by an aptamer or other binding agent. The target of interest may comprise a protein or polypeptide, a nucleic acid, including DNA, RNA, and various subspecies thereof, a lipid, a carbohydrate, a complex, e.g., a complex comprising protein, nucleic acids, lipids and/or carbohydrates. In some embodiments, the target of interest comprises a microvesicle. The target of interest can be a microvesicle surface antigen. The target of interest may be a biomarker, including a vesicle associated biomarker, in Tables 3 or 4. The microvesicle input can be isolated from a sample using various techniques as described herein, e.g., chromatography, filtration, centrifugation, flow cytometry, affinity capture (e.g., to a planar surface, column or bead), and/or using microfluidics. Detection aptamer 1504 is also bound to target of interest 1503. Detection aptamer 1504 carries label 1505 which can be detected to identify target captured to substrate 1501 via capture aptamer 1502. The label can be a fluorescent, radiolabel, enzyme, or other detectable label as disclosed herein. Either capture aptamer 1502 or detection aptamer 1504 can be substituted with another binding agent, e.g., an antibody. For example, the target may be captured with an antibody and detected with an aptamer, or vice versa. When the target of interest comprises a complex, the capture and detection agents (aptamer, antibody, etc) can recognize the same or different targets. For example, when the target is a microvesicle, the capture agent may recognize one microvesicle surface antigen while the detection agent recognizes another microvesicle surface antigen. Alternately, the capture and detection agents can recognize the same surface antigen.

The above configuration comprises a "sandwich" assay format which may comprise an immunoassay format such as ELISA or microbead assay. In other embodiments, target of interest 1503 is not captured to a substrate but is detected in solution. In such cases, detector aptamer 1504 can be contacted with the target of interest and detected directly in solution, e.g., using a flow cytometry assay or the like.

Aptamer Pools to Characterize a Sample

In an aspect, the invention provides a method of characterizing a sample by contacting the sample with a pool of different aptamers, and determining the frequency at which various aptamers in the pool bind the sample. For example, a pool of aptamers is identified that preferentially bind to microvesicles from cancer patients as compared to non-cancer patients. A test sample, e.g., from a patient suspected of having the cancer, is collected and contacted with the pool of aptamers. Aptamers that bind the test sample are eluted from the test sample, collected and identified, and the composition of the bound aptamers is compared to those known to bind cancer samples. Various sequencing, amplification and hybridization techniques can be used to identify the eluted aptamers. When a large pool of aptamers is used, aptamer identification may be performed by high throughput sequencing or via hybridization. If the test sample is bound by the aptamer pool in a similar manner (e.g., as determined by bioinformatics classification methods) to the microvesicles from cancer patients, then the test sample is indicative of cancer as well. Using this method, a pool of aptamers that bind one or more microvesicle antigen can be used to characterize the sample without necessarily knowing the precise target of each member of the pool of aptamers. Examples 23-24 herein illustrates an embodiment of the invention.

In an aspect, the invention provides a method for characterizing a condition for a test sample comprising: contacting a microvesicle sample with a plurality of oligonucleotide aptamers capable of binding one or more target(s) present in said microvesicle sample, identifying a set of oligonucleotides that form a complex with the sample wherein the set is predetermined to characterize a condition for the sample, thereby characterizing a condition for a sample.

In an related aspect, the invention provides a method for identifying a set of oligonucleotide aptamers associated with a test sample, comprising: (a) contacting a microvesicle sample with a plurality of oligonucleotides, isolating a set of oligonucleotides that form a complex with the microvesicle sample, (b) determining sequence and/or copy number for each of the oligonucleotides, thereby identifying a set of oligonucleotides associated with the test sample.

In still another related aspect, the invention provides a method of diagnosing a sample as cancerous or predisposed to be cancerous, comprising contacting a microvesicle sample with a plurality of oligonucleotide aptamers that are predetermined to preferentially form a complex with microvesicles from a cancer sample as compared to microvesicles from a non-cancer sample.

The oligonucleotides can be identified by sequencing, e.g., by dye termination (Sanger) sequencing or high throughput methods. High throughput methods can comprise techiques to rapidly sequence a large number of nucleic acids, including next generation techniques such as Massively parallel signature sequencing (MPSS; Polony sequencing; 454 pyrosequencing; Illumina (Solexa) sequencing; SOLiD sequencing; Ion Torrent semiconductor sequencing; DNA nanoball sequencing; Heliscope single molecule sequencing; Single molecule real time (SMRT) sequencing, or other methods such as Nanopore DNA sequencing; Tunnelling currents DNA sequencing; Sequencing by hybridization; Sequencing with mass spectrometry; Microfluidic Sanger sequencing; Microscopy-based techniques; RNAP sequencing; In vitro virus high-throughput sequencing. The oligonucleotides may also be identified by hybridization techniques. For example, a microarray having addressable locals to hybridize and thereby detect the various members of the pool can be used.

The plurality or pool of oligonucleotide aptamers can comprise any desired number of oligonucleotide aptamers to allow characterization of the sample. In various embodiments, the pool comprises at least 2, 3, 4, 5, 6, 7, 8, 9, 10, 11, 12, 13, 14, 15, 16, 17, 18, 19, 20, 25, 30, 40, 50, 60, 70, 80, 90, 100, 150, 200, 250, 300, 350, 400, 450, 500, 600, 700, 800, 900, 1000, 2000, 3000, 4000, 5000, 6000, 7000, 8000, 9000, or at least 10000 different oligonucleotide members.

The plurality of oligonucleotide aptamers can be preselected through one or more steps of positive or negative selection, wherein positive selection comprises selection of oligonucleotides against a sample having substantially similar characteristics compared to the test sample, and wherein negative selection comprises selection of oligonucleotides against a sample having substantially different characteristics compared to the test sample. Substantially similar characteristics mean that the samples used for positive selection are representative of the test sample in one or more characteristic of interest. For example, the samples used for positive selection can be from cancer patients or cell lines and the test sample can be a sample from a patient having or suspected to have a cancer. Substantially different characteristics mean that the samples used for negative selection differ from the test sample in one or more characteristic of interest. For example, the samples used for negative selection can be from individuals or cell lines that do not have cancer (e.g., "normal" or otherwise "control" samples) and the test sample can be a sample from a patient having or suspected to have a cancer. The cancer can be a breast cancer, ovarian cancer, prostate cancer, lung cancer, colorectal cancer, melanoma, brain cancer, or other cancer.

By selecting samples representative of the desired phenotypes to detect and/or distinguish, the characterizing can comprise a diagnosis, prognosis or theranosis for any number of diseases or disorders. Various diseases and disorders can be characterized using the compositions and methods of the invention, including without limitation a cancer, a pre-malignant condition, an inflammatory disease, an immune disease, an autoimmune disease or disorder, a cardiovascular disease or disorder, a neurological disease or disorder, an infectious disease, and/or pain. See section herein "Phenotypes" for further details. In embodiments, the disease or disorder comprises a proliferative or neoplastic disease or disorder. For example, the disease or disorder can be a cancer. In some embodiments, the cancer comprises a breast cancer, ovarian cancer, prostate cancer, lung cancer, colorectal cancer, melanoma, or brain cancer.

FIG. 15B is a schematic 1510 showing use of an aptamer pool to characterize a phenotype of a sample, such as those listed above. A pool of aptamers to a target of interst is provided 1511. For example, the pool of aptamers can be enriched to target one or more microvesicle. The members of the pool may bind different targets (e.g., a microvesicle surface antigen) or different epitopes of the same target present on the one or more microvesicle. The pool is contacted with a test sample to be characterized 1512. For example, the test sample may be a biological sample from an individual having or suspected of having a given disease or disorder. The mixture is washed to remove unbound aptamers. The remaining aptamers are eluted or otherwise disassociated from the sample and collected 1513. The collected aptamers are identified, e.g., by sequencing or hybridization. The presence and/or copy number of the identified is used to characterize the phenotype 1514. For example, the pool of aptamers may be chosen as aptamers that preferentially recognize microvesicles shed from cancer cells. The method can be employed to detect whether the sample retains aptamers that bind the cancer-related microvesicles, thereby allowing the sample to be characterized as cancerous or not.

FIG. 15C is a schematic 1520 showing an implementation of the method in FIG. 15B. A pool of aptamers identified as binding a microvesicle population is provided 1521. The microvesicle population can be isolated from a sample using various techniques as described herein, e.g., chromatography, filtration, ultrafiltration, centrifugation, ultracentrifugation, flow cytometry, affinity capture (e.g., to a planar surface, column or bead), and/or using microfluidics. The input sample comprises microvesicles that are isolated from a test sample 1522. For example, the test sample may be a biological sample from an individual having or suspected of having a given disease or disorder. The pool is contacted with the isolated microvesicles to be characterized 1523. The mixture is washed to remove unbound aptamers and the remaining aptamers are eluted or otherwise disassociated from the sample and collected 1524. The collected aptamers are identified 1525 and the presence and/or copy number of the retained aptamers is used to characterize the phenotype 1526 as above.

In an alternate embodiment to FIG. 15C, the pool of aptamers 1520 is directly contacted with a biological sample that comprises or is expected to comprise microvesicles. Microvesicles are thereafter isolated from the sample and the mixture is washed to remove unbound aptamers and the remaining aptamers are disassociated and collected 1524. The following steps are performed as above. As an example of this alternate configuration, a biological sample, e.g., a blood, serum or plasma sample, is directly contacted with the pool of aptamers. Microvesicles are then isolated by various techniques disclosed herein, including without limitation ultracentrifugation, ultrafiltration, flow cytometry, affinity isolation or the like. Remaining aptamers are then identified, e.g., by sequencing, hybridization or amplification.

In a related aspect, the invention provides a composition of matter comprising a plurality of oligonucleotides that can be used to carry out the methods comprising use of an aptamer pool to characterize a phenotype. The plurality of oligonucleotides can comprise any of those described herein, including one or more of SEQ ID NOs. 1-241535. In some embodiments, the plurality of oligonucleotides are selected from SEQ ID NOs. 1-230810. In still other embodiments, the plurality of oligonucleotides are selected from SEQ ID NOs. 230811-230899. The plurality of oligonucleotides can be selected from SEQ ID NOs. 230900-230927, or from SEQ ID NOs. 231018-241535. The composition may comprise any one of these sequences. The selected oligonucleotides may be capable of binding to a plurality of targets present in a biological sample. In some embodiments of the invention, the composition comprises at least 2, 3, 4, 5, 6, 7, 8, 9, 10, 11, 12, 13, 14, 15, 16, 17, 18, 19, 20, 25, 30, 40, 50, 60, 70, 80, 90, 100, 200, 300, 400, 500, 600, 700, 800, 900, 1000, 2000, 3000, 4000, 5000, 6000, 7000, 8000, 9000, 10000 or all oligonucleotides listed in SEQ ID NOs. 231018-241535. The composition may comprise at least 2, 3, 4, 5, 6, 7, 8, 9, 10, 11, 12, 13, 14, 15, 16, 17, 18, 19, 20, 25, 30, 40, 50, 60, 70, 80, 90, 100, 200, 300, 400, 500, 600, 700, 800, 900, 1000, 2000, 3000, 4000, 5000, 6000, 7000, 8000, 9000, 10000 or all oligonucleotides listed in SEQ ID NOs. 231018-241535. The composition of matter may also comprise one or more oligonucleotides set forth in any of Tables 23-24 which are capable of binding to a plurality of targets present in a biological sample. For example, the composition may comprise at least 1, 2, 3, 4, 5, 6, 7, 8, 9, 10, 11, 12, 13, 14, 15, 16, 17, 18, 19 or 20 oligonucleotides listed in Table 23 or Table 24. The oligonucleotides may be used in the subject methods to characterize a cancer sample, including without limitation a breast cancer sample or prostate cancer sample.

In a related aspect, the invention provides a method of performing high-throughput sequencing comprising: performing at least one (i) negative selection or (ii) one positive selection of a plurality of oligonucleotides with a microvesicle sample; obtaining a set of oliognucleotides to provide a negative binder subset or positive binder subset of the plurality of oligonucleotides, wherein the negative binder subset of the plurality of oligonucleotides does not bind the microvesicle sample and wherein the positive binder subset of the plurality of oligonucleotides does bind the microvesicle sample; contacting the negative binder subset or positive binder subset with a test sample; eluting oligonucleotides that bound to the test sample to provide a plurality of eluate oligonucleotides; and performing high-throughput sequencing of the plurality of eluate oligonucleotides to identify sequence and/or copy number of the members of the plurality of eluate oligonucleotides. Negative and positive selection of the plurality of oligonucleotides using microvesicle sample can be performed as disclosed herein. The aptamer profile revealed by the sequence and/or copy number of the members of the plurality of eluate oligonucleotides can be used to characterize a phenotype of the test sample as described herein.

In a similar aspect, the invention provides a method for identifying oligonucleotides specific for a test sample. The method comprises: (a) enriching a plurality of oligonucleotides for a sample to provide a set of oligonucleotides predetermined to form a complex with a target sample; (b) contacting the plurality in (a) with a test sample to allow formation of complexes of oligonucleotides with test sample; (c) recovering oligonucleotides that formed complexes in (b) to provide a recovered subset of oligonucleotides; and (d) profiling the recovered subset of oligonucleotides by high-throughput sequencing or hybridization, thereby identifying oligonucleotides specific for a test sample. The test sample may comprise a plurality of microvesicles. The oligonucleotides may comprise RNA, DNA or both. In some embodiment, the method further comprises performing informatics analysis to identify a subset of oligonucleotides comprising sequence identity of at least 50%, 55%, 60%, 65%, 70%, 75%, 80%, 85%, 90%, 91%, 92%, 93%, 94%, 95%, 96%, 97%, 98%, or at least 99% to the oligonucleotides predetermined to form a complex with the target sample.

The invention further provides a kit to facilitate use of an aptamer pool to characterize a phenotype. The kit may comprise a reagent for carrying out the subject methodology. Relatedly, the invention provides for use of a reagent for carrying out such methods. The reagent may comprise an aptamer, a pool of aptamers, or a composition comprising such aptamers as described above.

Nucleic Acid Negative Controls

In another aspect, the invention provides a negative control composition comprising a non-target binding nucleic acid and a substrate. The non-target binding nucleic acid can be provided by the selection methods of the invention described above, wherein the nucleic acid is identified as a non-target binding aptamer. For example, the non-binding aptamer can be identified as a non-target binding aptamer during positive selection. In some embodiments, the non-binding aptamer is predicted to have minimal if any secondary structure. Once a nucleic acid sequence is identified, its sequence can be analyzed using a software program to estimate its two-dimensional folding structure. Well-known sequence alignment programs and algorithms for motif identification can be used to identify sequence motifs and reduce the dimensionality of even large data sets of sequences. Further, software programs such as Vienna and mfold are well-known to those skilled in the art of aptamer selection and can be used to further group sequences based on secondary structure motifs (shared shapes).

The non-target binding nucleic acid can be associated with the substrate. The association can be via covalent or non-covalent binding. In some embodiments, the non-target binding nucleic acid is conjugated to the substrate. A detection assay as described herein or known in the art can be performed using the composition as a negative control. The negative control can be used in any appropriate manner. For example, when using a microtiter plate or planar array (see, e.g., FIG. 1A), a well or an area of the array can be contacted with the non-target binding nucleic acid. The assay can be performed and any signal resulting from the area of the array contacted with the non-target binding nucleic acid can be subtracted from the assay signal derived from the target.

Similarly, a when using a microbead array in an assay (see, e.g., FIG. 1B), a portion of beads can be included in the assay that are contacted with the non-target binding nucleic acid. The assay can be performed and any signal resulting from the beads contacted with the non-target binding nucleic acid can be subtracted from the assay signal derived from the target. As noted, the non-target binding nucleic acid may or may not be conjugated to the substrate as desired.

In an embodiment, the non-target binding, negative control nucleic acid of the invention comprises a nucleic acid having a sequence at least 50, 55, 60, 65, 70, 75, 80, 85, 90, 91, 92, 93, 94, 95, 96, 97, 98, 99, or 100% homologous to a sequence selected from the group consisting of any of SEQ ID NOs. 230938-231008. For example, the nucleic acid can have a sequence at least 91, 92, 93, 94, 95, 96, 97, 98, 99, or 100% homologous to a sequence selected from the group consisting of any of SEQ ID NOs. 230938-231008. The nucleic acid can have the sequence of any of SEQ ID NOs. 230938-231008, e.g., SEQ ID NO. 230938. The nucleic acid can be used as a negative control nucleic acid according to the methods and compositions of the invention.

In a related aspect, the invention provides a method of detecting a presence or level of a biological entity in a biological sample suspected of containing the biological entity, comprising: (a) providing a composition comprising a substrate and a negative control composition as described above, wherein the substrate comprises one or more binding agent to the biological entity; (b) contacting the biological sample with the composition provided in step (a); (c) detecting a target signal corresponding to the amount of biological entity recognized by the one or more binding agent in step (b); and (d) normalizing the target signal detected in step (c) to a control signal corresponding to the amount of signal produced by the negative control composition, thereby detecting the presence or level of the biological entity in the biological sample. As noted, normalizing the target signal may comprise subtracting the control signal from the target signal.

The one or more binding agent can be an antibody, aptamer, or other appropriate binding agent disclosed herein or known in the art. Similarly, the biological entity can be any appropriate biomarker disclosed herein or known in the art. In an embodiment, the biological entity comprises a protein. In another embodiment, the biological entity comprises a microvesicle. In such case, the one or more binding agent can be specific to a microvesicle surface antigen. The microvesicle surface antigen may be an antigen disclosed herein, e.g., in Tables 3-4. In some embodiments, the microvesicle surface antigen is a biomarker of a disease or disorder. Accordingly, the method may provide a diagnosis, prognosis or theranosis of the disease or disorder.

In an embodiment, the invention provides an isolated polynucleotide, or a fragment thereof, identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In an aspect, the invention provides negative control aptamers wherein the aptamer sequences comprise scrambled versions of a target binding nucleic acid. For example, aptamers herein are disclosed that bind proteins (e.g., EpCAM, PSMA) or microvesicles (e.g., prostate and breast cancer microvesicles). A negative control for any of the target binding aptamers can be a randomly scrambled sequence thereof.

The invention further provides a kit for carrying out the methods of the invention. As further described below, the kit may comprise one or more reagent for carrying out the method. In certain embodiments, the one or more reagent comprises the non-target binding, negative control nucleic acid or the negative control composition. The kit may comprise the substrate and/or a binding agent of interest to a target of interest. The negative control composition may be used to normalize a signal produced by binding of a binding agent and a target of interest.

Blocking Aptamers

In some embodiments, the nucleic acids of the invention serve as a blocking agent for the substrate. Following a coupling reaction between a substrate and a desired molecule or entity, e.g., a binding agent, blocking agents can be applied to the substrate to minimize non-specific interactions between the coated substrate and non-target molecules. Blocking agents can be selected to minimize nonspecific interactions but not interfere with any desired interactions, such as specific interaction between a molecule of interest conjugated to the substrate and another molecule of interest in a test solution. Commonly used blockers include BSA (bovine serum albumin), casein (a milk-based protein), pepticase (hydrolyzed casein), non-ionic surfactants (e.g., Tween® 20 and Triton® X-100), non-reacting antibodies or fragments thereof (e.g., off-species), FSG (fish skin gelatin), pure gelatin or a gelatin hydrolase, PEG (polyethylene glycol), non-reacting sera, non-reacting protein, and various commercially available blockers known to those in the art. A non-reacting protein refers to a protein that should have minimal, if any, interaction with components of an assay.

Figure 16A:
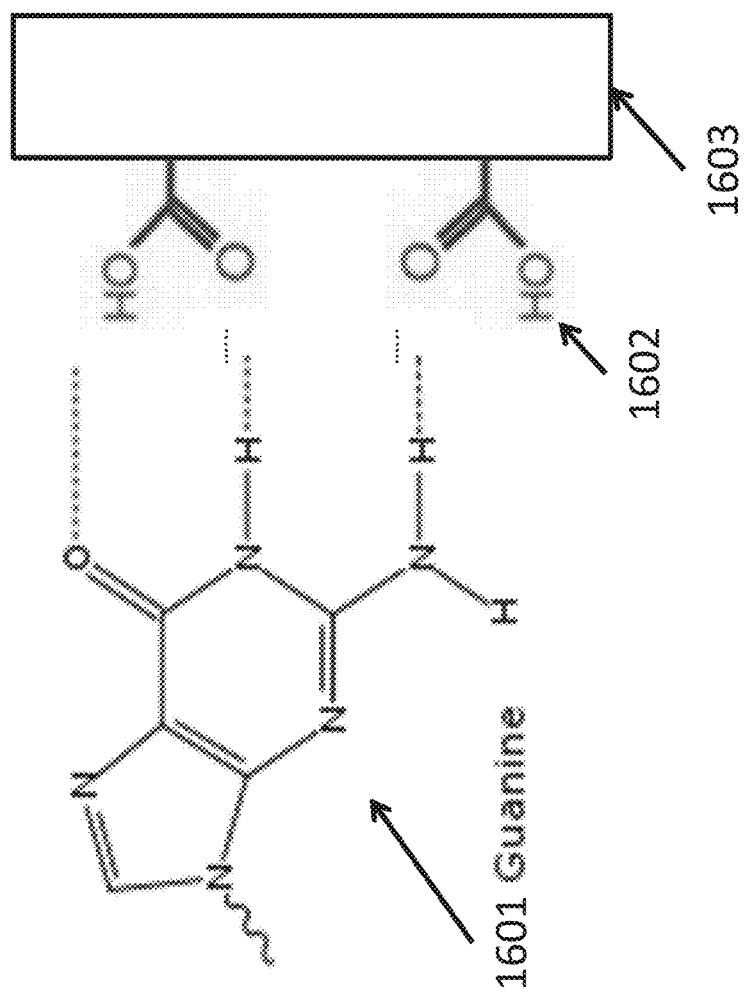
FIG. 16A illustrates hydrogen bonding between a portion of an aptamer 1601 to carboxyl groups 1602 attached to a planar substrate 1603.
Figure 16B:
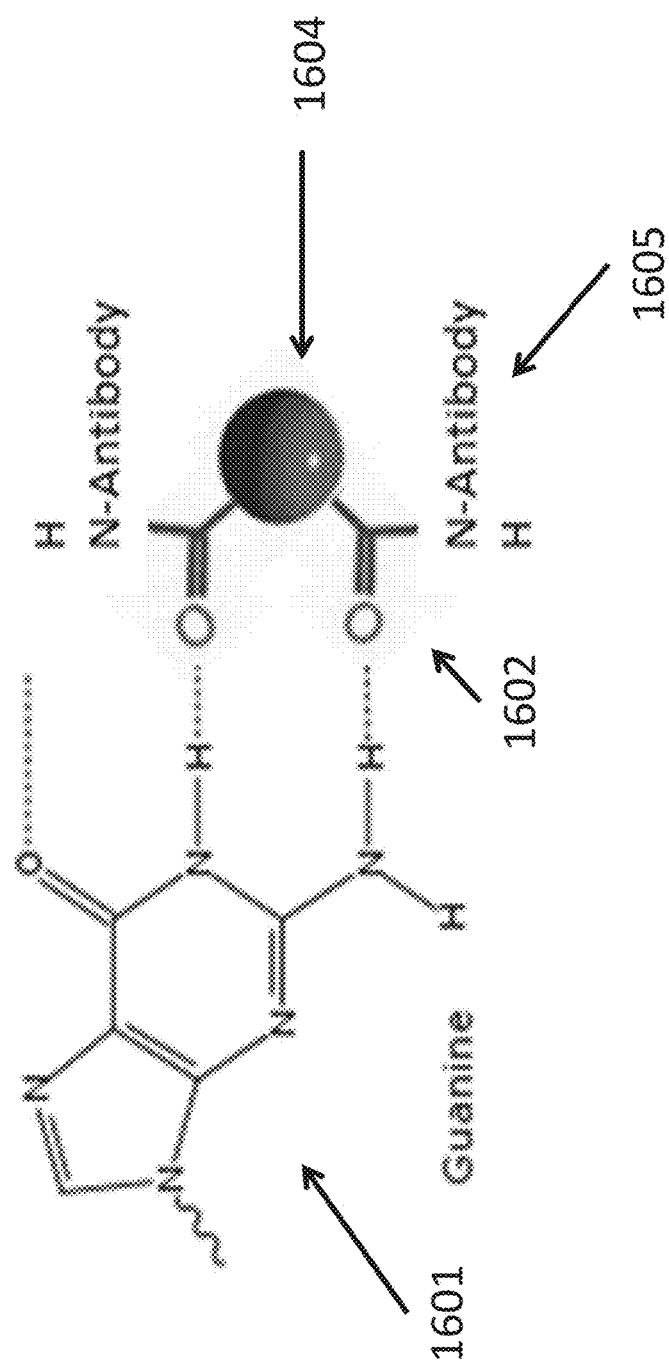
FIG. 16B illustrates hydrogen bonding between a portion of an aptamer 1601 to carboxyl groups 1602 attached to a microsphere substrate 1604. Carboxyl groups 1602 are further attached to an antibody 1605.

FIGS. 16A-16B illustrate use of an aptamer to block an unconjugated carboxyl group on a substrate. FIG. 16A illustrates hydrogen bonding between a portion of an aptamer 1601 to carboxyl groups 1602 attached to a planar substrate 1603. FIG. 16B illustrates hydrogen bonding between a portion of an aptamer 1601 to carboxyl groups 1602 attached to a microsphere substrate 1604. Carboxyl groups 1602 are further attached to an antibody 1605. Guanine is the only one nucleotide which can form two hydrogen bounds.

In an aspect, the invention provides a non-binding nucleic acid. The non-binding nucleic acid can be selected to have minimal, if any, interaction with components of an assay of interest. For example, the non-binding nucleic acid can have minimal, if any, interaction with the target molecules of an assay of interest. However, the blocking aptamer may bind other assay components, e.g., substrates, tubes, beads, etc, thereby minimizing interaction between the target molecules and any assay components other than the binding agents specific for the target molecules. The invention also provides blocking compositions comprising the non-binding nucleic acid and one or more blocking component selected from the group consisting of BSA (bovine serum albumin), casein (a milk-based protein), pepticase (hydrolyzed casein), non-ionic surfactants (e.g., Tween® 20 and Triton® X-100), non-reacting antibodies or fragments thereof (e.g., off-species), FSG (fish skin gelatin), pure gelatin or a gelatin hydrolase, PEG (polyethylene glycol), non-reacting sera, non-reacting protein, and various commercially available blockers known to those in the art.

In an embodiment, the non-binding nucleic acid comprises a sequence at least 50, 55, 60, 65, 70, 75, 80, 85, 90, 91, 92, 93, 94, 95, 96, 97, 98, 99, or 100% homologous to a sequence selected from the group consisting of any of SEQ ID NOs. 230938-231008. For example, the nucleic acid can have a sequence at least 91, 92, 93, 94, 95, 96, 97, 98, 99, or 100% homologous to a sequence selected from the group consisting of any of SEQ ID NOs. 230938-231008. The nucleic acid can have the sequence of any of SEQ ID NOs. 230938-231008, e.g., SEQ ID NO. 230938.

In a related aspect, the invention provides a method comprising contacting the non-binding nucleic acid with a substrate to block the substrate, contacting a biological sample with the blocked substrate, and detecting binding of one or more biological entity to the substrate. The non-binding nucleic acid can be included in a blocking composition provided above. The substrate can also be a substrate such as described herein, including without limitation a planar substrate or a microsphere. Such blocking can inhibit in full or in part undesired binding events.

The invention further provides a kit for carrying out the methods of the invention. As further described below, the kit may comprise one or more reagent for carrying out the method. In certain embodiments, the one or more reagent comprises the non-binding nucleic acid or the blocking composition. The kit may comprise the substrate and/or a binding agent of interest to a target of interest. The non-binding nucleic acid or the blocking composition may be used for blocking the substrate.

In an embodiment, the invention provides an isolated polynucleotide, or a fragment thereof, identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In some embodiments, blocking aptamers are selected that bind to functional groups, e.g., functional groups that are present on one or more component of a biological assay. Such functional group binding aptamers are described in further detail below.

Functional Group Binding Aptamers

In an aspect, the invention provides an aptamer capable of binding a functional group of interest. Functional groups as used herein are groups of atoms or bonds within molecules that are responsible for the characteristic chemical reactions of those molecules. The same functional group will undergo the same or similar chemical reaction(s) regardless of the size of the molecule it is a part of. However, its relative reactivity can be modified by nearby functional groups. A "moiety" can be a functional group or can be comprised of one or more functional groups.

The atoms of functional groups are linked to each other and to the rest of the molecule by covalent bonds. When the group of covalently bound atoms bears a net charge, the group can be referred to as a polyatomic ion or a complex ion. Any subgroup of atoms of a compound also may be called a radical, and if a covalent bond is broken homolytically, the resulting fragment radicals are referred as free radicals.

Aptamers of the invention can be directed to various functional groups of interest. The functional group may include without limitation hydrocarbons, halogens, groups containing oxygen (i.e., C—O bonds), groups containing nitrogen, groups containing sulfur, groups containing phosphorus, or groups containing boron. Illustrative hydrocarbons include without limitation alkanes, alkenes, alkynes, benzene derivatives, toluene derivatives, branched or ring alkanes, carbocations and carboanions. Illustrative halogens include without limitation haloalkanes, fluoroalkanes, chloroalkanes, bromoalkanes and iodoalkanes. Illustrative groups containing oxygen include without limitation alcohols, ketones, aldehydes, acyl halides, carbonates, carboxylates, carboxylic acids, esters, hydroperoxides, ethers, hemiacetals, hemiketals, acetals, ketals, orthoesters, and orthocarbonates. Illustrative groups containing nitrogen include without limitation amides, amines, imines, imides, azides, azo compounds, cyanates, nitrates, nitriles, nitrites, nitro compounds, nitroso compounds, and pyridine derivatives. Illustrative groups containing sulfur include without limitation thiols, sulfides, disulfides, sulfoxides, sulfones, sulfunic acids, sulfonic acids, thiocyantes, isothyanates, thiones, and thials. Illustrative groups containing phosphorus include without limitation phosphines, phosphanes, phophonic acids, phosphates, and phosphodiesters. Illustrative groups containing boron include without limitation boronic acids, boronic esters, borinic acids and borinic esters.

The aptamers of the invention can be directed to one or more functional groups selected from the group consisting of acetals, acyl groups, acyl halides, alkenyl groups, alkoxides, alkoxy groups, alkynyl groups, amides, amine oxides, amines, carbodiimides, carboximidates, carboxylic acids, cyanamides, cyanates, dithiocarbamates, enols, esters, ethers, hydrazines, hydrazones, hydroxamic acids, imides, isocyanates, isocyanides, isothiocyanates, ketals, ketenes, ketones, leaving groups, nitriles, organohalides, organophosphorus, orthoesters, oximes, phosphonofluoridates, phosphonothioates, phosphoramidothioates, phosphorodithioates, phosphorofluoridates, phosphorothioates, protecting groups, pyrophosphates, semicarbazides, semicarbazones, sulfamates, sulfonate esters, sulfones, sulfonic acids, sulfonyl groups, sulfoximines, sulfuryl compounds, thioamides, thiocyanates, thioesters, thiolates, thiones, thiophosphoryl compounds, and thiosulfinates.

The aptamers of the invention can be directed to one or more functional group selected from the group consisting of acetal, acetoxy group, acetylide, acid anhydride, activating group, acyl chloride, acyl halide, acylal, acyloin, acylsilane, alcohol, aldehyde, aldimine, alkane, alkene, alkoxide, alkyl cycloalkane, alkyl nitrites, alkyne, allene, amide, amidine, aminal, amine oxide, azide, azine, aziridine, azoxy, bifunctional, bisthiosemicarbazone, biuret, boronic acid, carbamate, carbamino, carbazide, carbene, carbinol, carbonate ester, carbonyl, carboxamide, carboximidate, carboxylic acid, chloroformate, cumulene, cyanate ester, cyanimide, cyanohydrin, deactivating groups, depside, diazo, diol, dithiocarbamate, enamine, enediyne, enol, enol ether, enone, enyne, episulfide, epoxide, ester, ether, fluorosulfonate, halohydrin, haloketone, hemiacetal, hemiaminal, hemithioacetal, hydrazide, hydrazone, hydroxamic acid, hydroxyl, hydroxylamine, imine, iminium, isothiouronium, ketene, ketenimine, ketone, ketyl, lactam, lactol, lactone, methine, methyl group, nitrate, nitrile ylide, nitrilimine, nitro compound, nitroamine, nitronate, nitrone, nitronium ion, nitrosamine, nitroso, orthoester, osazone, oxaziridine, oxime, n-oxoammonium salt, peroxide, peroxy acid, persistent carbene, phenols, phosphaalkene, phosphaalkyne, phosphate, phosphinate, phosphine, phosphine oxide, phosphinite, phosphonate, phosphonite, phosphonium, phosphorane, s-nitrosothiol, schiff base, selenol, selenonic acid, selone, semicarbazide, semicarbazone, silyl enol ether, silyl ether, sulfenamide, sulfenic acid, sulfenyl chloride, sulfide, sulfilimine, sulfinamide, sulfinic acid, sulfite ester, sulfonamide, sulfonanilide, sulfonate, sulfonyl, sulfonyl halide, sulfoxide, sulfuryl, sultone, tellurol, thial, thioacetal, thioamide, thiocarbamate, thiocarboxy, thiocyanate, thioester, thioether, thioketal, thioketone, thiol, thiolactone, thiourea, tosylhydrazone, triazene, triol, urea, vanillyl, xanthate, ylide, and ynolate.

The functional group can be tethered to the surface of a substrate to facilitate the covalent attachment of other molecules to the surface of the substrate. For example, the substrate may be carboxyl-modified, amino-modified, hydroxyl-modified, hydrazide-modified and/or chloromethyl-modified.

In an embodiment, the aptamer binds to a carboxyl group. The aptamer can have a high GC content, e.g., greater than 50%, 60%, 70%, 80%, 90%, 95% or more GC content. The nucleic acid sequence of the aptamer may be a nucleic acid having a sequence at least 50, 55, 60, 65, 70, 75, 80, 85, 90, 91, 92, 93, 94, 95, 96, 97, 98, 99, or 100% homologous to a sequence selected from the group consisting of any of SEQ ID NOs. 230938-231008. For example, the nucleic acid can have a sequence at least 91, 92, 93, 94, 95, 96, 97, 98, 99, or 100% homologous to a sequence selected from the group consisting of any of SEQ ID NOs. 230938-231008. The nucleic acid can have the sequence of any of SEQ ID NOs. 230938-231008, e.g., the aptamer can have the sequence of SEQ ID NO. 230938.

In some embodiments, the aptamer is further modified to comprise at least one chemical modification. The chemical modification can be selected from the group consisting: of a chemical substitution at a sugar position; a chemical substitution at a phosphate position; and a chemical substitution at a base position of the nucleic acid. The chemical modification can also be selected from the group consisting of: incorporation of a modified nucleotide, 3' capping, conjugation to an amine linker, conjugation to a high molecular weight, non-immunogenic compound, conjugation to a lipophilic compound, conjugation to a drug, conjugation to a cytotoxic moiety, and labeling with a radioisotope. The cytotoxic moiety can be conjugated to the 5' end of the aptamer, it can be conjugated to the 3' end of the aptamer, or a cytotoxic moiety can be conjugated to both ends of the aptamer. In some embodiments, the cytotoxic moiety is encapsulated in a nanoparticle, e.g., a liposome, dendrimer, and/or comb polymer. In other embodiments, the cytotoxic moiety comprises a small molecule cytotoxic moiety. The small molecule cytotoxic moiety can be selected from the group consisting of vinblastine hydrazide, calicheamicin, *vinca* alkaloid, a cryptophycin, a tubulysin, dolastatin-10, dolastatin-15, auristatin E, rhizoxin, epothilone B, epithilone D, taxoids, maytansinoids, and variants and derivatives of any thereof. The cytotoxic moiety can also be a protein toxin. In embodiments, the protein toxin is selected from the group consisting of diphtheria toxin, ricin, abrin, gelonin, and *Pseudomonas* exotoxin A. The radioisotope can be selected from the group consisting of yttrium-90, indium-111, iodine-131, lutetium-177, copper-67, rhenium-186, rhenium-188, bismuth-212, bismuth-213, astatine-211, and actinium-225. The non-immunogenic, high molecular weight compound can be a polyalkylene glycol, such as polyethylene glycol.

In another aspect, the invention provides a composition comprising an aptamer of the invention, e.g., as described above, and a substrate. As decribed herein, the substrate can be any physically separable solid to which a binding agent can be directly or indirectly attached including, but not limited to, surfaces provided by microarrays and wells, particles such as beads, columns, optical fibers, wipes, glass and modified or functionalized glass, quartz, mica, diazotized membranes (paper or nylon), polyformaldehyde, cellulose, cellulose acetate, paper, ceramics, metals, metalloids, semiconductive materials, quantum dots, coated beads or particles, other chromatographic materials, magnetic particles; plastics (including acrylics, polystyrene, copolymers of styrene or other materials, polypropylene, polyethylene, polybutylene, polyurethanes, Teflon material, etc.), polysaccharides, nylon or nitrocellulose, resins, silica or silica-based materials including silicon and modified silicon, carbon, metals, inorganic glasses, plastics, ceramics, conducting polymers (including polymers such as polypyrole and polyindole); micro or nanostructured surfaces such as nucleic acid tiling arrays, nanotube, nanowire, or nanoparticulate decorated surfaces; or porous surfaces or gels such as methaciylates, acrylamides, sugar polymers, cellulose, silicates, or other fibrous or stranded polymers. In addition, as is known the art, the substrate may be coated using passive or chemically-derivatized coatings with any number of materials, including polymers, such as dextrans, acrylamides, gelatins or agarose. The substrate can also be coated with a functional group to facilitate covalent attachment to the surface of any desired molecules. Such coatings can facilitate the use of the array with a biological sample. The substrate can be in any useful form. In an embodiment, the substrate is a planar substrate. For example, the substrate can be the well of a plate, or a microarray. In another embodiment, the substrate is a microsphere. For example, the substrate can be a magnetic or fluorescently labeled microsphere or bead.

In an embodiment, the substrate of the composition comprises a carboxyl group. For example, the surface of the substrate can be coated with a functional group such as a carboxyl group. The aptamer can be bound to the carboxyl group. In an embodiment, the aptamer binds the carboxyl group via hydrogen binding.

In some embodiments, the aptamer serves as a blocking agent for the substrate. Following a coupling reaction between a substrate and a desired molecule or entity, e.g., a binding agent, blocking agents can be applied to the substrate to minimize non-specific interactions between the coated substrate and non-target molecules. Blocking agents can be selected to minimize nonspecific interactions but not interfere with any desired interactions, such as specific interaction between a molecule of interest conjugated to the substrate and another molecule of interest in a test solution. Commonly used blockers include BSA (bovine serum albumin), casein (a milk-based protein), pepticase (hydrolyzed casein), non-ionic surfactants (e.g., Tween® 20 and Triton® X-100), non-reacting antibodies or fragments thereof (e.g., off-species), FSG (fish skin gelatin), pure gelatin or a gelatin hydrolase, PEG (polyethylene glycol), non-reacting sera, and various commercially available blockers known to those in the art.

In an embodiment, the substrate comprises a binding agent. The binding agent can be a nucleic acid, protein, or other molecule that can bind to a target of interest, e.g., a biological entity. In preferred embodiment, the binding agent has specificity for the target of interest. The binding agent can comprise DNA, RNA, monoclonal antibodies, polyclonal antibodies, Fabs, Fab', single chain antibodies, synthetic antibodies, aptamers (DNA/RNA), peptoids, zDNA, peptide nucleic acids (PNAs), locked nucleic acids (LNAs), lectins, synthetic or naturally occurring chemical compounds (including but not limited to drugs, labeling reagents), dendrimers, or a combination thereof. For example, the binding agent can be an antibody or an aptamer. In embodiments of the invention, the binding agent comprises a membrane protein labeling agent. See, e.g., the membrane protein labeling agents disclosed in Alroy et al., US. Patent Publication US 2005/0158708.

The composition can comprise further entities. In embodiments, the composition comprises a biological entity. For example, the biological entity can be a nucleic acid/polynucleotide, a protein, or a microvesicle. In an embodiment, the protein is associated with a microvesicle. For example, the protein can be a microvesicle surface antigen. The protein can also be a microvesicle payload. The microvesicle surface antigen and/or payload may be a biomarker disclosed herein, e.g., in Tables 3-4.

Figure 17A:
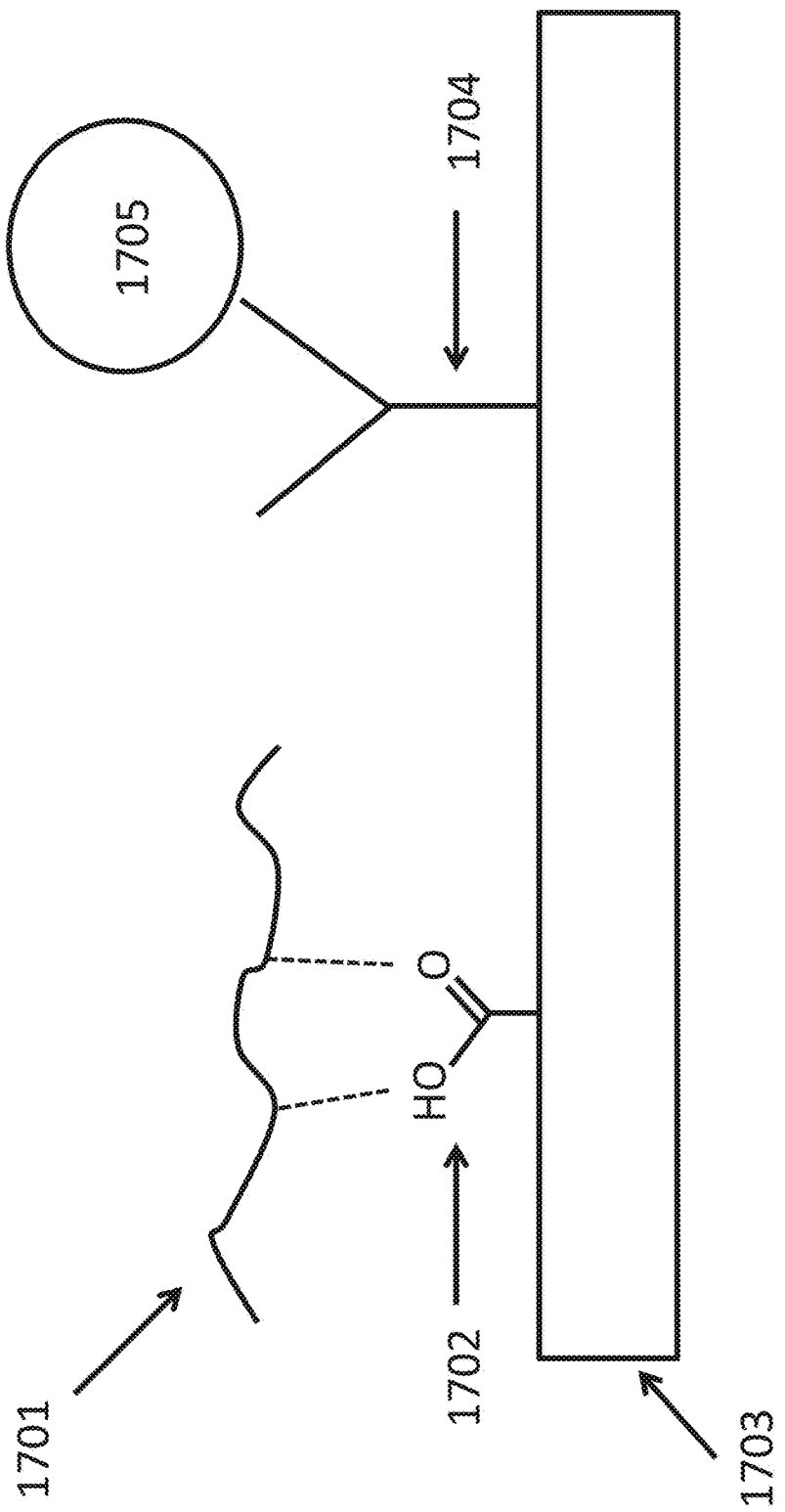
FIG. 17A and FIG. 17B illustrate hydrogen bonding between a portion of an aptamer 1701 to carboxyl groups 1702 attached to a substrate 1703.
Figure 17B:
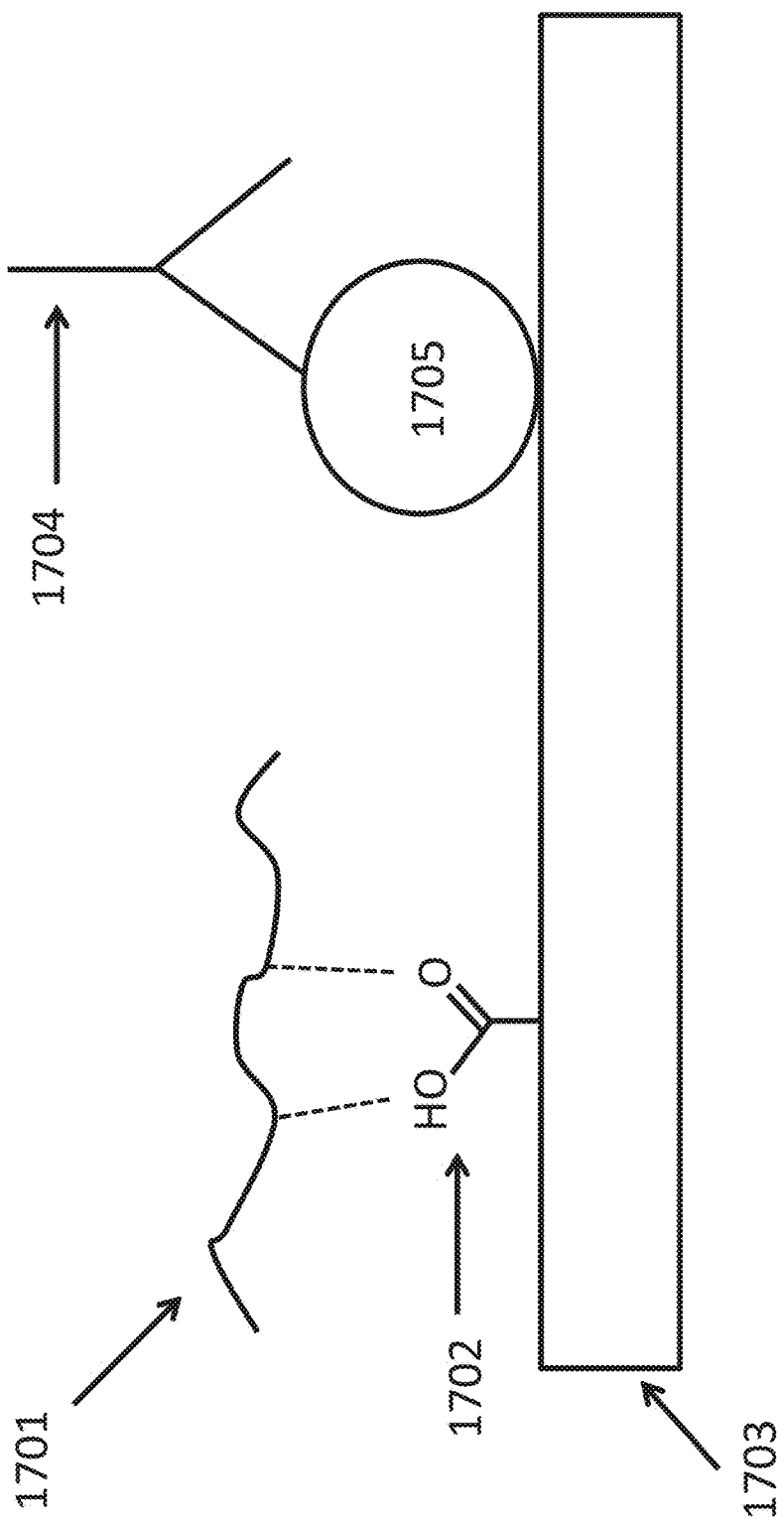
Figures 18A, 18B, 18C, 18D:
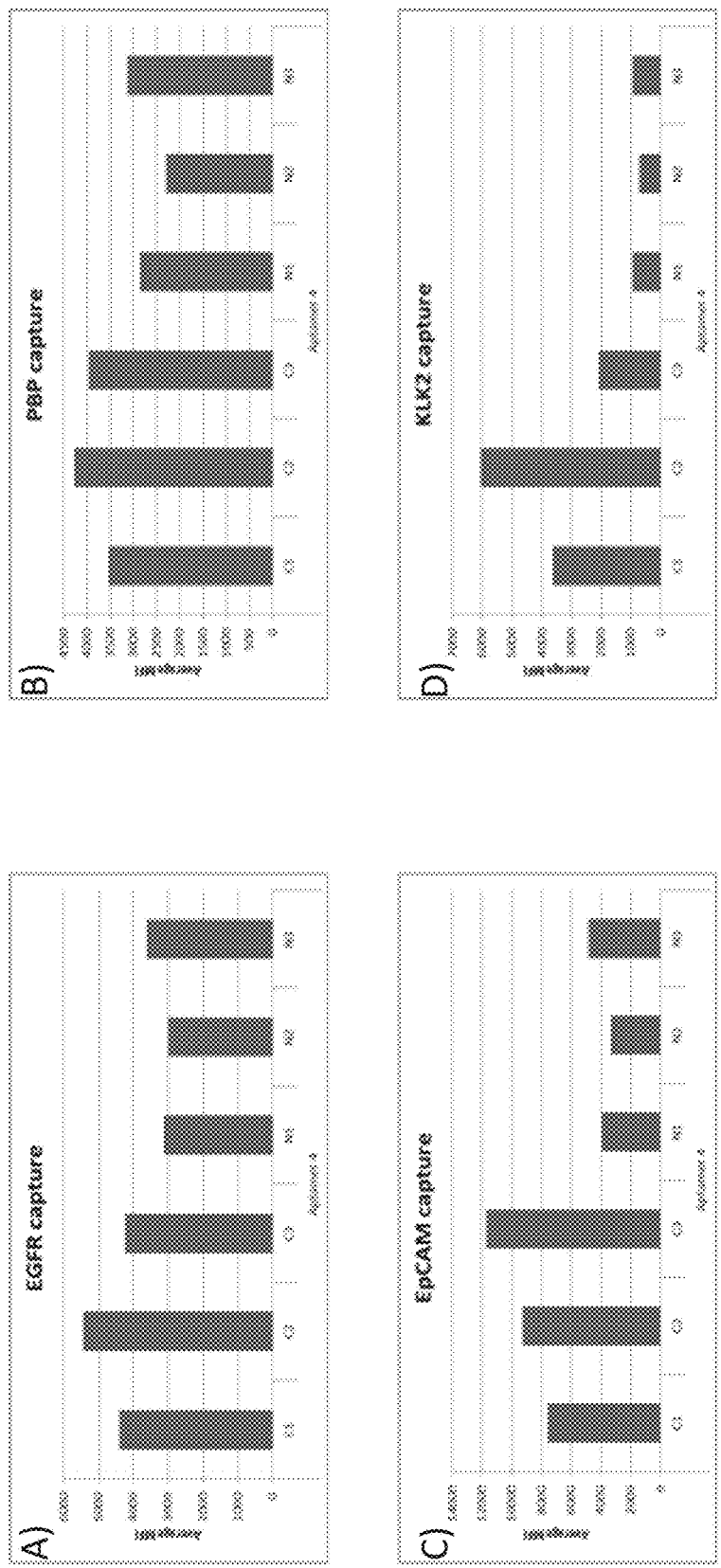
FIGS. 18A-18D illustrate the use of an anti-EpCAM aptamer (Aptamer 4; SEQ ID NO. 1) to detect a microvesicle population. Vesicles in patient plasma samples were captured using bead-conjugated antibodies to the indicated microvesicle surface antigens.

An exemplary configuration of a composition of the invention is shown in FIG. 17A. FIG. 17A illustrates hydrogen bonding between a portion of an aptamer 1701 to carboxyl groups 1702 attached to a substrate 1703. Binding agent 1704 is also attached to the substrate 1703. The binding agent has specificity for target 1705, which may be any appropriate biological entity described herein or known in the art, such as a protein, nucleic acid, microvesicle, cell, or a portion of any thereof. Without being bound by theory, the aptamer 1701 may serve to block some or all undesired binding of the target 1705, or any other molecule or entity, to the substrate 1703. FIG. 17B shows an alternate configuration wherein a biological entity of interest is bound to the substrate 1703.

As described further below, the invention provides a kit comprising an aptamer or composition of the invention, such as those described above.

In still another aspect, the invention provides a method comprising contacting the aptamer of the invention with a substrate. The aptamer can be an aptamer of the invention such as described above. The substrate can also be a substrate such as described above, including a planar substrate, or a microsphere. The substrate may comprise a carboxyl group. For example, the surface of the substrate can be functionalized with carboxyl moieties. In embodiments, the aptamer is bound to the carboxyl group. The aptamer can be bound to the carboxyl group via hydrogen bonding. Without being bound by theory, the aptamer may serve to block carboxyl groups on the substrate from undesired binding events.

In an embodiment, the substrate comprises a binding agent. The binding agent can be any binding agent disclosed herein or known in the art that can be attached via covalent or non-covalent bonds to the substrate. In some embodiments, the binding agent comprises an antibody or aptamer.

The method of contacting the aptamer of the invention with a substrate may further comprise contacting the substrate with a sample comprising a target of the binding agent.

One possible configuration for the method is shown in FIG. 17A. As shown in FIG. 17A, the target 1705 is recognized by the binding agent 1704 while the carboxyl group 1702 is masked by the aptamer 1701. In embodiments, the surface of substrate 1703 is covered by carboxyl groups 1702 to facilitate covalent attachment of binding agent 1704 to the substrate. After attachment of binding agent 1704 to substrate 1703, the aptamer 1701 can be applied to block any unconjugated carboxyl group 1702. Finally, the blocked substrate 1703 can be contacted with a sample comprising the target 1705. The method may enhance the ability to detect binding events between the binding agent 1704 and target 1705. For example, blocking by the aptamer may reduce any non-specific binding events with the substrate 1703 that could interfere with specific binding between the binding agent 1704 and target 1705. Alternately, blocking by the aptamer may reduce any non-specific binding events between the target 1705 and the substrate 1703. One of skill will appreciate that both mechanisms may operate simultaneously. FIG. 17B shows an alternate configuration wherein a biological entity of interest is bound to the substrate 1703.

In an embodiment, the invention provides an isolated polynucleotide, or a fragment thereof, identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

The invention further provides a kit for carrying out the methods of the invention. As further described below, the kit may comprise one or more reagent for carrying out the method. In certain embodiments, the one or more reagent comprises the aptamer and/or the substrate.

In another aspect, the invention provides a method of detecting a presence or level of a biological entity in a biological sample suspected of containing the biological entity. The method comprises: (a) providing a composition comprising one or more binding agent specific to the biological entity attached to a carboxylated substrate, wherein the carboxylated substrate is bound to the aptamer provided by the invention; (b) contacting the biological sample with the composition provided in step (a); and (c) detecting whether the biological entity is recognized by the one or more binding agent in step (b), thereby detecting the presence or level of the biological entity in the biological sample. One possible configuration for the method is shown in FIG. 17A. As shown in FIG. 17A, the target 1705 is recognized by the binding agent 1704 while the carboxyl group 1702 is masked by the aptamer 1701. In embodiments, the surface of substrate 1703 is covered by carboxyl groups 1702 to facilitate covalent attachment of binding agent 1704 to the substrate. After attachment of binding agent 1704 to substrate 1703, the aptamer 1701 can be applied to block any unconjugated carboxyl group 1702. Finally, the blocked substrate 1703 can be contacted with a sample comprising the target 1705. The method may enhance the ability to detect binding events between the binding agent 1704 and target 1705. For example, blocking by the aptamer may reduce any non-specific binding events with the substrate 1703 that could interfere with specific binding between the binding agent 1704 and target 1705. Alternately, blocking by the aptamer may reduce any non-specific binding events between the target 1705 and the substrate 1703. One of skill will appreciate that both mechanisms may operate simultaneously. FIG. 17B shows an alternate configuration wherein a biological entity of interest is bound to the substrate 1703.

The biological entity can be any appropriate entity that can be detected when recognized by the binding agent. In an embodiment, the biological entity comprises a protein or polypeptide. As used herein, "protein," "polypeptide" and "peptide" are used interchangeably unless stated otherwise. The biological entity can be a nucleic acid, including DNA, RNA, and various subspecies of any thereof as disclosed herein or known in the art. The biological entity can comprise a lipid. The biological entity can comprise a carbohydrate. The biological entity can also be a complex, e.g., a complex comprising protein, nucleic acids, lipids and/or carbohydrates. In some embodiments, the biological entity comprises a microvesicle. In such cases, the binding agent can be a binding agent to a microvesicle surface antigen, e.g., a protein. General microvesicle surface antigens include tetraspanin, CD9, CD63, CD81, CD63, CD9, CD81, CD82, CD37, CD53, Rab-5b, Annexin V, and MFG-E8. Additional general microvesicle surface antigens are provided in Table 3 herein.

The microvesicle surface antigen can also be a biomarker of a disease or disorder. The method may provide a diagnosis, prognosis or theranosis of the disease or disorder. For example, the one or more protein may comprise one or more of PSMA, PCSA, B7H3, EpCam, ADAM-10, BCNP, EGFR, IL1B, KLK2, MMP7, p53, PBP, SERPINB3, SPDEF, SSX2, and SSX4. These markers can be used detect a prostate cancer. Additional microvesicle surface antigens are provided in Tables 3-4 herein.

The invention further provides a kit for carrying out the methods of the invention. As further described below, the kit may comprise one or more reagent for carrying out the method. In certain embodiments, the one or more reagent comprises the aptamer, the substrate, and/or the binding agent. The kit may comprise the substrate coated with the carboxyl group, instructions for conjugating a binding agent of interest to the substrate, and the aptamer. The aptamer may be used for blocking any unconjugated carboxyl groups.

In a related aspect, the invention provides a method for enhancing binding comprising: (a) contacting a substrate with an aptamer capable of binding a carboxyl group, wherein the substrate also comprises one or more selected nucleic acid or polypeptide molecules; and (b) contacting the substrate with a binding agent capable of binding the nucleic acid or polypeptide molecule, whereby the aptamer binding to the carboxyl group enhances the binding of the binding agent to the nucleic acid or polypeptide molecule. The aptamer can be an aptamer of the invention, e.g., an aptamer having a sequence selected from SEQ ID NOs. 230938-231008. The substrate can be a substrate such as described herein or known in the art, including planar substrates or microspheres/beads. An illustrative schematic is shown in FIG. 17A and FIG. 17B. With respect to FIG. 17A, the substrate 1703 comprises the one or more selected nucleic acid or polypeptide molecules 1704, which in this illustration represents an antibody. The aptamer 1701 is shown binding a carboxyl group 1702 on the surface of the substrate 1703. The binding agent 1705 is a molecule or entity that binds the one or more selected nucleic acid or polypeptide molecules 1704. With respect to FIG. 17B, the substrate 1703 comprises the one or more selected nucleic acid or polypeptide molecules 1705, which in this illustration represents a target entity, e.g., a protein or microvesicle. The aptamer 1701 is shown binding a carboxyl group 1702 on the surface of the substrate 1703. The binding agent 1704 is an antibody specific for the one or more selected nucleic acid or polypeptide molecule 1705. One of skill will appreciate that various binding agents can be used as disclosed herein or known in the art.

The nucleic acid or polypeptide can be covalently bound to a carboxyl group via an amide linkage. A amide bond, or peptide bond, is a covalent chemical bond formed between two molecules when the carboxyl group of one molecule reacts with the amino group of the other molecule, causing the release of a molecule of water.

The aptamers of the invention can be identified using any useful selection methodology. For example, an aptamer can be identified using SELEX or variants thereof, such as described in Pan and Clawson, Primer-free aptamer selection using a random DNA library. Methods Mol Biol. 2010; 629:369-85; which publication is herein incorporated by reference in its entirety. The aptamer can be identified using negative and positive selection methods such as described herein. The aptamer can be identified using the method described by Mei, H, et al. Functional-group specific aptamers indirectly recognizing compounds with alkyl amino group. Anal Chem. 2012 Sep. 4; 84(17):7323-9. Epub 2012 Aug. 21; which publication is herein incorporated by reference in its entirety.

Kits

The invention also provides a kit comprising one or more reagent to carry out the methods of the invention. For example, the one or more reagent can be the one or more aptamer, a buffer, blocker, enzyme, or combination thereof. The one or more reagent may comprise any useful reagents for carrying out the subject methods, including without limitation aptamer libraries, substrates such as microbeads or planar arrays or wells, reagents for biomarker and/or microvesicle isolation, aptamers directed to specific targets, aptamer pools that facilitate detection of a biomarker/microvesicle population, reagents such as primers for nucleic acid sequencing or amplification, arrays for nucleic acid hybridization, detectable labels, solvents or buffers and the like, various linkers, various assay components, blockers, and the like. The one or more reagent may also comprise various compositions provided by the invention. In an embodiment, the one or more reagent comprises one or more aptamer of the invention. The one or more reagent can comprise a substrate, such as a planar substate, column or bead. The kit can contain instructions to carry out various assays using the one or more reagent.

In an embodiment, the kit comprises an aptamer or composition provided herein. The kit can be configured to carry out the methods provided herein. For example, the kit can include an aptamer of the invention, a substrate, or both an aptamer of the invention and a substrate.

In an embodiment, the kit is configured to carry out an assay. For example, the kit can contain one or more reagent and instructions for detecting the presence or level of a biological entity in a biological sample. In such cases, the kit can include one or more binding agent to a biological entity of interest. The one or more binding agent can be bound to a substrate.

In an embodiment, the kit comprises a set of aptamers that provide a particular aptamer profile for a biological sample. An aptamer profile can include, without limitation, a profile that can be used to characterize a particular disease or disorder. For example, the disease or disorder can be a proliferative disease or disorder, including without limitation a cancer.

Example 1: Identification of DNA Oligonucleotides that Bind a Target

The target is affixed to a solid substrate, such as a glass slide or a magnetic bead. For a magnetic bead preparation, beads are incubated with a concentration of target protein ranging from 0.1 to 1 mg/ml. The target protein is conjugated to the beads according to a chemistry provided by the particular bead manufacturer. Typically, this involves coupling via an N-hydroxysuccinimide (NHS) functional group process. Unoccupied NHS groups are rendered inactive following conjugation with the target.

Randomly generated oligonucleotides (oligos) of a certain length, such as 32 base pairs long, are added to a container holding the stabilized target. Each oligo contains 6 thymine nucleotides (a "thymine tail") at either the 5 or 3 prime end, along with a single molecule of biotin conjugated to the thymine tail. Additional molecules of biotin could be added. Each oligo is also manufactured with a short stretch of nucleotides on each end (5-10 base pairs long) corresponding to amplification primers for PCR ("primer tails"). The sequences of a large pool of 32-mer aptamers are shown in SEQ ID NOs. 1-230810. The sequences are shown absent the thymine tails or primer tails.

The oligonucleotides are incubated with the target at a specified temperature and time in phosphate-buffered saline (PBS) at 37 degrees Celsius in 500 microliter reaction volume.

The target/oligo combination is washed 1-10 times with buffer to remove unbound oligo. The number of washes increases with each repetition of the process (as noted below).

The oligos bound to the target are eluted using a buffer containing a chaotropic agent such as 7 M urea or 1% SDS and collected using the biotin tag. The oligos are amplified using the polymerase chain reaction using primers specific to 5' and 3' sequences added to the randomized region of the oligos. The amplified oligos are added to the target again for another round of selection. This process is repeated as necessary to observe binding enrichment.

Example 2: Competitive Assay

The process is performed as in Example 1 above, except that a known ligand to the target, such as an antibody, is used to elute the bound oligo species (as opposed to or in addition to the chaotropic agent). In this case, anti-EpCAM antibody from Santa Cruz Biotechnology, Inc. was used to elute the aptamers from the target EpCAM.

Example 3: Screening and Affinity Analysis

Aptamers generated from the binding assays described above are sequenced using a high-throughput sequencing platform, such as the Ion Torrent from Life Technologies:

Library Preparation—Aptamers were pooled after ligating barcodes and adapter sequences (Life Technologies) according to manufacturer protocols. In brief, equimolar pools of the aptamers were made using the following steps:

Analyzed an aliquot of each library with a Bioanalyzer™ instrument and Agilent DNA 1000 Kit or Agilent High Sensitivity Kit, as appropriate for the final library concentration. The molar concentration (nmol/L) of each amplicon library was determined using the commercially available software (Agilent).

An equimolar pool of the library was prepared at the highest possible concentration.

The combined concentration of the pooled library stock was calculated.

The template dilution factor of the library pool was determined using the following equation: Template Dilution Factor=(Library pool concentration [pM])/26 pM).

Template Preparation—Using a freshly diluted library, the aptamer pool resulting from binding assays provided above were sequenced using conventional sequencing protocols. High throughput (NextGen) sequencing methods can be used as desired. The aptamer pool sequences are identified in SEQ ID NOs. 1-230810.

Twenty aptamers were selected based on direct or competitive assays assessing binding to EpCAM (as described above). See Example 7 and Table 8 for the selected sequences.

Affinity Measurements—These twenty aptamers were then tested for binding affinity using an in vitro binding platform. SPR can be used for this step, e.g., a Biacore SPR machine using the T200 control software, as follows:

Dilute the antigen to a concentration of 32 nM.

Prepare necessary dilutions for kinetics, starting at 32 nM prepare two-fold dilutions of antigen down to 0.5 nM.

The Biacore 200 control software is programmed with the following conditions: Solution: HBS-EP+ Buffer; Number of cycles: 3; Contact time: 120s; Flow rate: 30 l/min; Dissociation time: 300s; Solution: Glycine-HCl pH 2.5; Contact time: 120s; Flow rate: 20l/min; Stabilization period: 0s. The binding affinities of these aptamers are then measured using the SPR assay above, or an alternate in vitro assay assessing the aptamer for a desired function.

Figure 4:
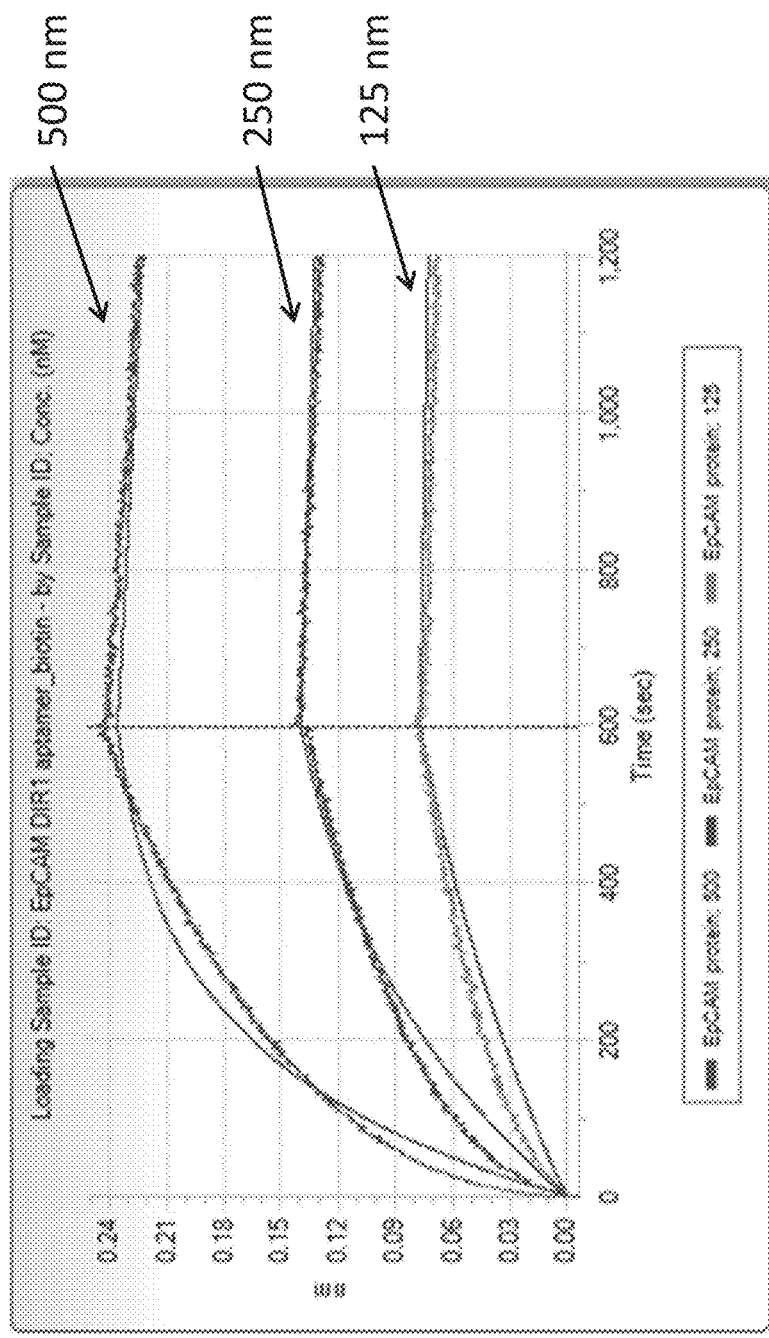
FIG. 4 illustrates results from a binding assay showing the binding affinity of an exemplary aptamer (Aptamer ID BTX176881 (SEQ ID NO. 98883)) to the target EpCAM protein at various target concentrations. The aptamer to be tested is fixed to a substrate using a biotin tail and is incubated with various concentrations of target (125, 250 and 500 nM, as indicated in the figure). The test is performed on a surface plasmon resonance machine (SPR). The SPR machine detects association and disassociation of the aptamer and the target. Target is applied until the association and disassociation events are equal, resulting in a plateau of the curve. The equations describing the curve at each concentration can then be used to calculate the $K_D$ of the aptamer (see Table 5).
Figure 5B:
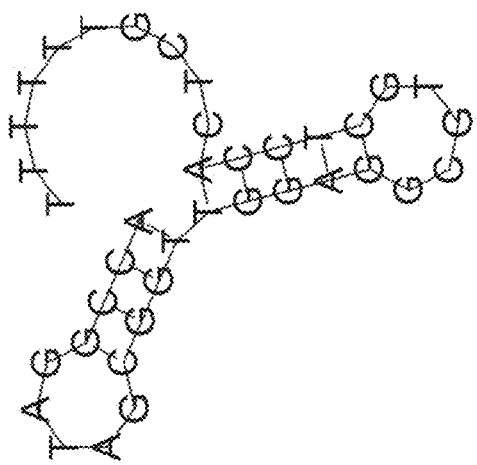
FIGS. 5A-5B illustrate aptamer nucleotide sequences and corresponding secondary structure prediction.
Figure 5A:
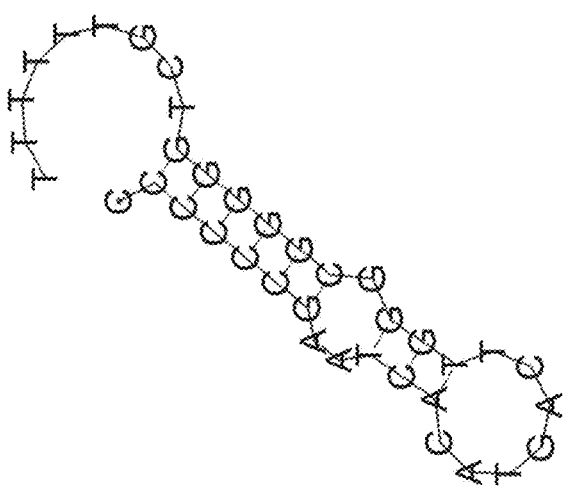

FIG. 4 shows the SPR data for aptamer BTX176881 (SEQ ID NO: 98883). The figure comprises an association and dissociation graph of 1:1 fitting model of the biotinylated aptamers to EpCAM protein at the indicated concentrations (nM). Table 5 shows the calculated $K_d$ values from the SPR measurements that are illustrated in FIG. 4. In addition, Table 5 shows the SPR data and calculated $K_d$ values for BTX187269 (SEQ ID NO: 109271) and Aptamer 4 (SEQ ID NO. 1).

Example 4: Motif Analysis

The process in the Examples above is followed to identity a high affinity aptamer to a target of interest. Once a high affinity aptamer is identified, its sequence is then analyzed using a software program to estimate its two-dimensional folding structure. Well-known sequence alignment programs and algorithms for motif identification can be used to identify sequence motifs and reduce the dimensionality of even large data sets of sequences. Further, software programs such as Vienna and mfold are well-known to those skilled in the art of aptamer selection and can be used to further group sequences based on secondary structure motifs (shared shapes). See FIGS. 5A-5B for example structure predictions. Shared secondary structure of course, does not guarantee identical three-dimensional structure. Therefore "wet-lab" validation of aptamers is still useful as no one set of in silico tools has yet been able to accurately predict the optimal aptamer among a set of aptamer candidates.

Using the same software, the sequences produced in high-throughput sequencing of a pool of candidate aptamers (produced as described in Example 1 above) are analyzed for structural motifs similar to the high-affinity aptamer. The structure comparisons are based on free energy calculations performed using Vienna. Tables 6 and 7 present an illustrative selection of free energy calculations for the top twenty library members calculated to have high identity to Aptamer 4 (SEQ ID NO. 1) and Oligo6 (SEQ ID NO. 230810), respectively. In Tables 6 and 7, the column "Identity" indicates the identical alignment proportion of Aptamer 4 to the indicated library sequences. The identity value comprises the result of pairwise alignment divided by number of nucleotides in the alignment. The column "mfeCode" comprises "dot-bracket notation" output from Vienna 2.0.7. Pseudo-knot free secondary structures can be represented in the space-efficient dot-bracket notation, which is used throughout the Vienna RNA package. Briefly, a structure on a sequence of length n is represented by a string of equal length consisting of matching brackets and dots. A base pair between base i and j is represented by a '(' at position i and a ')' at position j, and unpaired bases are represented by dots. Further information on the mfeCode dot-bracket notation is available at ma.tbi.univie.ac.at/help.html. The column "mfe-Value" in Tables 6 and 7 provides the mimimum free energy calculation as calculated with Vienna 2.0.7 with default parameter file.

TABLE 5

Calculated $K_D$ values from SPR measurements

| Immobilized aptamer | Analyte | Conc (nM) | Response | $K_d$ (nM) | Full $R^2$ | Full Chi$^2$ |
|---|---|---|---|---|---|---|
| BTX176881 | EpCAM | 500 | 0.2434 | 8.40 | 0.989322 | 0.179008 |
| (SEQ ID No: | protein | 250 | 0.136 | 8.40 | 0.989322 | 0.179008 |
| 98883) | | 100 | 0.0776 | 8.40 | 0.989322 | 0.179008 |
| BTX187269 | EpCAM | 500 | 0.2575 | 7.12 | 0.990323 | 0.215697 |
| (SEQ ID NO: | protein | 250 | 0.1584 | 7.12 | 0.990323 | 0.215697 |
| 109271) | | 100 | 0.0551 | 7.12 | 0.990323 | 0.215697 |
| Aptamer 4 | EpCAM | 500 | 0.2742 | 10.10 | 0.986276 | 0.299279 |
| (SEQ ID NO. 1) | protein | 250 | 0.1618 | 10.10 | 0.986276 | 0.299279 |
| | | 100 | 0.0809 | 10.10 | 0.986276 | 0.299279 |

*$K_d$, $R^2$ and Chi$^2$ values by Global fitting for single reference method.

TABLE 6

Identity and Secondary Structure Comparison to Aptamer 4

| ID | Sequence (5'->3') | Identity | mfeCode | mfeValue (kcal/mol) |
|---|---|---|---|---|
| Aptamer4 (SEQ ID NO. 1) | CCCCCCGAATCACATGACTTGGGCGGGGTCG | 1 | ((((((((.((....)).))))).))).... | -13.5 |
| BTX175447 (SEQ ID NO. 97449) | CCCCCCGAATCACATGACTTGGGCGGGGTCG | 1 | ((((((((.((....)).))))).))).... | -13.5 |
| BTX100359 (SEQ ID NO. 22361) | CCGCCAGCATAACTGACTAGTGCTGTCTTTTT | 0.78125 | ....(((((..........))))))....... | -6 |
| BTX6393 (SEQ ID NO. 160929) | CCGGCCATCACTGCCTTTAACGTGGTGGTTTT | 0.75 | ..((((((((...........))))))))).. | -10.7 |
| BTX141572 (SEQ ID NO. 63574) | TCCTCACGAATGTGACTGACGTGGGGTTTTAC | 0.75 | .(((((((...........))))))))..... | -9.3 |
| BTX53793 (SEQ ID NO. 208329) | TCTCCTGAATGTGTTGTTCGGGGATGTTTTGT | 0.75 | ..(((((((.....)))))))).......... | -7.8 |
| BTX176890 (SEQ ID NO. 98892) | CCGCGCTACATCACATGCTGGGGCAGGTCGCC | 0.75 | ((((.(((((((...))).)))).)).))..... | -7.5 |
| BTX34119 (SEQ ID NO. 188655) | ACCGAACAGTGTCGGGCGGGGTGGAGGTGTTT | 0.75 | .(((...(.......)...)))........ | -5.1 |
| BTX4758 (SEQ ID NO. 159294) | CCCACGCTACACCTGGCGAGCGTTCGTTTTTT | 0.75 | ....(((((....))))))............ | -5 |
| BTX175446 (SEQ ID NO. 97448) | CCCCCCGAATCACAGGTTGGTCCGTTGAAATT | 0.75 | ((...((.........))..))........... | -2.9 |
| BTX6079 (SEQ ID NO. 160615) | CCGCGATCCACGTAAGGTTCGGGGGTCTCTTT | 0.71875 | ((.(((.((......)).))).)).... | -10.6 |
| BTX112777 (SEQ ID NO. 34779) | CTGGGTCCTGTTGGGCTGGGGTCGGTCTTGAT | 0.71875 | ((.(((((....)))))).)).......... | -10.4 |
| BTX18213 (SEQ ID NO. 172749) | TAGCCCGCCAGATACTTGGGTGGGAATCCTTT | 0.71875 | ....((((((...........))))))).... | -10.2 |
| BTX186007 (SEQ ID NO. 108009) | CTCTGCTCAATGCGTGGGCTGGGGCGGTCAGT | 0.71875 | ..((((((....((.....))...)))))).... | -10.1 |
| BTX178871 (SEQ ID NO. 100873) | CCTTGAAGACTGGGCGCTGGTCCTAGCTCTTT | 0.71875 | ....((((((((((((.....).))))).).)))) | -9.7 |
| BTX27728 (SEQ ID NO. 182264) | GCGCTGGAACTCGTGACAGTGCGTGGCGTTTT | 0.71875 | ((((((...........)))))).......... | -8.8 |
| BTX39166 (SEQ ID NO. 193702) | CCAGCCCTGGATCCCATTGACCTCGGGATTG | 0.71875 | .((((((((((.((......)).).))))))).))) | -7.6 |
| BTX79672 (SEQ ID NO. 1674) | AATCACCGATGGGCGGGAATCACGTGTTGGT | 0.71875 | ....(((((((.(.((.....)).).))))))) | -7.6 |
| BTX13384 (SEQ ID NO. 167920) | GCGACGCATGTGTTGTGCTGTGCTCGTGTTTT | 0.71875 | ((((.(((((((......)).)))))))).... | -7.5 |

TABLE 6-continued

Identity and Secondary Structure Comparison to Aptamer 4

| ID | Sequence (5'->3') | Identity | mfeCode | mfeValue (kcal/mol) |
|---|---|---|---|---|
| BTX4712 (SEQ ID NO. 159248) | CCCACAATCGACAGCGAAC TTGGGGGGTGCGG | 0.71875 | ((((....(((.....)))...)))) ........ | -7.5 |

In total, 880 sequences had an identity score of 0.65 or higher as compared to Aptamer4. The SEQ ID NOs. of these sequences ordered by identity to Aptamer4 from high to low are 1, 83833, 404, 192457, 46196, 181195, 85436, 159336, 174291, 83832, 188968, 14201, 91259, 95567, 87637, 152235, 164943, 208225, 37604, 173781, 229801, 162649, 141236, 229277, 197636, 208288, 222015, 46488, 41404, 20282, 37215, 164674, 88106, 230291, 222830, 86840, 106217, 153548, 69938, 22919, 148527, 23133, 62644, 150047, 195461, 165410, 95492, 187335, 143568, 229624, 211801, 89529, 49853, 86203, 229309, 148998, 227639, 12831, 207967, 83812, 100031, 24403, 44443, 86417, 85531, 177048, 222142, 224357, 191046, 25876, 176402, 78410, 169614, 170692, 220915, 227125, 88394, 211129, 167260, 21437, 95247, 229151, 1344, 18302, 94815, 105377, 130159, 47458, 77703, 229665, 446, 6632, 222154, 5925, 89185, 166992, 82685, 190696, 227012, 165589, 140293, 165488, 184824, 22443, 89500, 139968, 26382, 223375, 21852, 175936, 191752, 227183, 229246, 28597, 79173, 218544, 90815, 115055, 118391, 147334, 228629, 63019, 112671, 14867, 31453, 49788, 83331, 170600, 182781, 65037, 77839, 219756, 22498, 169879, 84231, 87890, 87951, 93241, 95274, 25145, 229605, 229647, 145760, 5602, 5944, 129548, 229432, 148342, 165400, 62962, 71321, 130354, 227261, 96175, 1923, 3602, 88544, 112311, 229170, 168079, 195903, 203783, 129930, 208300, 215426, 224543, 227717, 82099, 221395, 10847, 61398, 99233, 165100, 208999, 15946, 44819, 164778, 190331, 224367, 181869, 221786, 229009, 67955, 87277, 202044, 63204, 97683, 119091, 127373, 176380, 2790, 182858, 226993, 40773, 86822, 149227, 189749, 223226, 109, 7382, 142902, 190403, 2511, 14476, 125189, 224206, 86454, 130486, 147726, 108815, 18082, 190843, 45237, 83778, 191228, 229117, 96465, 171461, 186224, 82242, 176191, 181376, 184432, 147735, 214179, 159297, 2709, 45318, 105849, 171053, 222127, 52894, 125871, 164642, 84142, 45997, 86837, 94742, 130073, 175675, 222007, 112130, 221515, 127575, 141509, 525, 173934, 201340, 135715, 209835, 23712, 83926, 6015, 215164, 206485, 5690, 50212, 118847, 61503, 202365, 225979, 8859, 45779, 176358, 113963, 45463, 66945, 188869, 15231, 22936, 84157, 12271, 58672, 135632, 180563, 200213, 12292, 74327, 88219, 163713, 208378, 229071, 3089, 12468, 140336, 155915, 331, 115507, 206325, 225180, 230194, 21183, 113125, 229023, 41920, 105992, 210427, 213341, 76296, 104423, 146335, 178047, 228984, 12604, 83530, 90950, 185519, 222186, 222283, 27831, 88097, 116409, 154939, 168206, 5549, 195919, 217797, 22658, 154805, 171036, 214987, 225767, 62979, 85662, 222046, 224554, 226930, 227276, 27161, 166910, 202893, 8124, 8714, 23847, 39241, 27746, 165206, 166056, 423, 36640, 86849, 137280, 190114, 202287, 230304, 5179, 6067, 6505, 6611, 41483, 37479, 45749, 107382, 117315, 202535, 29748, 82654, 84060, 87907, 157362, 206589, 223382, 28495, 44462, 62270, 100524, 173820, 192490, 222297, 1390, 19210, 22495, 118163, 133889, 179659, 192074, 204965, 2461, 77762, 106037, 166379, 167776, 182280, 228707, 808, 47456, 152081, 222818, 229813, 148355, 148387, 167853, 167857, 187723, 357, 163173, 175586, 224340, 12254, 24110, 158863, 199558, 228579, 500, 85061, 94630, 162650, 165617, 168065, 222121, 228609, 51102, 112611, 125773, 190879, 215724, 227812, 229506, 442, 12284, 36658, 44057, 95079, 97943, 167653, 177081, 204180, 209922, 18882, 62824, 89180, 107532, 131610, 179747, 181924, 208078, 208690, 631, 46216, 96215, 105283, 150525, 166187, 227449, 103425, 185880, 837, 26023, 157638, 165823, 175971, 228232, 230020, 36086, 61478, 171159, 177192, 196612, 215002, 225782, 84127, 88107, 111059, 147670, 149254, 166308, 175530, 206924, 221620, 2514, 2717, 23418, 51045, 83895, 83974, 84095, 84146, 86150, 104166, 106868, 152996, 185740, 222844, 229172, 229254, 27401, 160516, 165619, 172635, 189302, 220615, 221183, 229356, 230021, 83828, 124068, 152013, 181636, 190744, 194448, 195157, 196263, 215307, 229390, 229807, 28160, 33150, 84689, 150169, 170181, 175758, 202239, 1872, 7459, 22350, 39454, 82329, 101757, 151736, 162225, 7946, 83756, 159512, 164932, 185169, 217855, 229824, 7381, 45608, 55427, 85522, 92756, 94362, 149604, 166378, 166572, 185619, 1200, 20260, 20952, 22787, 78128, 80744, 108103, 116667, 129831, 130067, 168581, 178969, 208724, 222116, 8122, 144078, 164779, 218167, 220960, 22637, 24612, 24944, 106584, 156344, 167262, 222022, 228813, 44051, 77865, 82089, 88152, 93245, 94935, 152153, 190789, 200547, 201908, 225916, 1323, 2837, 10181, 22043, 25177, 26567, 93412, 104099, 127374, 130454, 147664, 150419, 177674, 183092, 9715, 12644, 22918, 40833, 77732, 82992, 83365, 210202, 229833, 3976, 11015, 13524, 65438, 90954, 98759, 148864, 163106, 163192, 74660, 79359, 83110, 95108, 95525, 112590, 171072, 172776, 183058, 224159, 226062, 228518, 12809, 15906, 23455, 42107, 76961, 91318, 129989, 137160, 155158, 177958, 2759, 46018, 48333, 78031, 86611, 128087, 135823, 180253, 191245, 209093, 230546, 20542, 63496, 71991, 83901, 142432, 171932, 227515, 61337, 160422, 172960, 173608, 189801, 210407, 216678, 229101, 65755, 79467, 94134, 98247, 197374, 202491, 225597, 77739, 94166, 95667, 151387, 168443, 187779, 220937, 5921, 7576, 148846, 177037, 190387, 190580, 190594, 229692, 12103, 32693, 92399, 114220, 163673, 223983, 652, 5953, 22926, 45297, 119857, 181369, 190352, 227216, 173208, 191585, 207218, 214989, 229099, 229137, 19556, 20676, 20726, 55409, 63187, 82431, 83731, 91667, 108942, 167838, 208244, 208660, 226483, 486, 98243, 147746, 186732, 190125, 222129, 13059, 47113, 63281, 63816, 147364, 191597, 194319, 226191, 80867, 88703, 141125, 165353, 7836, 44100, 84750, 97305, 151159, 163292, 166160, 174457, 187346, 206359, 212868, 3743, 4210, 7231, 77720, 101878, 151668, 158168, 203331, 226481, 12095, 51060, 78232, 85545, 145684, 164617, 169839, 180765, 203890, 209861, 222276, 12511, 120891, 163107, 171003, 176280, 20466, 195366, 222140, 72978, 141852, 158096, 162904, 2767, 8748, 105451, 111950, 229203, 229612, 6031, 12231, 93001, 172784, 174080, 195635, 222160, 2077, 148220, 190414, 207102, 84111, 89221, 177736, 222281, 51841, 83873, 112121, 129029, 130969, 147734, 148231, 148343, 152004, 172491, 192443, 200375, 230195, 165471, 169651, 87960, 230440, 83966, 101115, 158138, 191593, 191892, 229621, 13073, 31147, 44055, 71915, 905, 130121, 130286, 83984, 94826, 201315, 2654, 3052, 5288, 62828, 109159, 45345, 57797, 77490, 83203, 150059, 180295, 210195, 227209, 229074, 7529, 86462, 87778, 130059, 229341, 83520, 14855, 45242, 51014, 89143, 163311, 164805, 206146, 210232, 156377, 172805, 192953, 4313, 22875, 63708, 77497, 165430, 187428, 190477, 105395, 176513, 172889, 217595, 2587, 75016, 193089, 12089, 211658, 61730, 61745, 63353, 83986, 84548, 94951, 124283, 229118.

TABLE 7

| | Identity and Secondary Structure Comparison to Oligo6 | | | |
|---|---|---|---|---|
| ID | Sequence (5'->3') | Identity | mfeCode | mfeValue (kcal/mol) |
| BTX28676 (SEQ ID NO. 183212) | GGCGCAGGGGGGGCCCAG AGTATGGGGCCTG | 1 | ..........(((.((((......)))).))). | -12.2 |
| Oligo6 (SEQ ID NO. 230810) | GGCGCAGGGGGGGCCCAG AGTATGGGGCCTG | 1 | ..........(((.((((......)))).))). | -12.2 |
| BTX165089 (SEQ ID NO. 87091) | ATCGCCCAGGGCAGCCAAG AGATGGGCCCTGC | 0.75 | ......(((((((...(((......))))))))))). | -12.5 |
| BTX125376 (SEQ ID NO. 47378) | GCTTGGGAGGTGGGCCTGG TAGTGTGGGCCTG | 0.75 | ...........(((((((......))))))). | -9.7 |
| BTX148478 (SEQ ID NO. 70480) | TTACAGCCCAGGTGGGGGA GATGGAGGCCTG | 0.75 | .....((((................))))... | -6 |
| BTX54083 (SEQ ID NO. 208619) | TGACGCAGGCGGCCGATAG TCATGGGAAGGCT | 0.75 | ......((.(...((.((.....)).)..).)) | -5 |
| BTX138117 (SEQ ID NO. 60119) | TAGCGAGGGATGTGCCAGA GCAAGGGGCGATG | 0.75 | ..........(((.((........)).))).... | -4.6 |
| BTX151736 (SEQ ID NO. 73738) | TTTTGGTGGTTTTGGGCAC AGAGATCCGCCTT | 0.71875 | ....((((((((((....)))))..))))).. | -9.4 |
| BTX165901 (SEQ ID NO. 87903) | ATGATTTCTGGCGCTGGGC AGGCGGCGTACTG | 0.71875 | ..........((((((......)))))).... | -8.7 |
| BTX45567 (SEQ ID NO. 200103) | GATATTTTGGCGCTGGGGT ACTAACGGGGCT | 0.71875 | .........(((.((.(..........).)).))) | -7.9 |
| BTX102652 (SEQ ID NO. 24654) | CCTCGTTGGAGAAGGGGTG CCGGGTATTGGCT | 0.71875 | ((((.........)))).(((......)))). | -7.6 |
| BTX139961 (SEQ ID NO. 61963) | TCAGCTCAGGTCGGGGCCT CGAGTAGGGTCGT | 0.71875 | ...(((((((((....)))).)))))........ | -7.6 |
| BTX168333 (SEQ ID NO. 90335) | ATTTTTGGAGGCGTCGGCC ACTTAGGCGGCCT | 0.71875 | ........((((.....(((......)).)))) | -7.2 |
| BTX164283 (SEQ ID NO. 86285) | ATATCTTGTCTGCATGGAG GGCAATGGTGGCG | 0.71875 | .((((((((((........)))))).)))).... | -6.8 |
| BTX118000 (SEQ ID NO. 40002) | GATGGGCGCAGGAGGGGGC AGAGCTTCACCTA | 0.71875 | .........(((...(((((...))))).))). | -6.5 |
| BTX56414 (SEQ ID NO. 210950) | TTTTGGTTGTAAGCATGCG ATGGCGATATGCT | 0.71875 | ...........(((((((((.....)).))))))) | -6.3 |

TABLE 7-continued

Identity and Secondary Structure Comparison to Oligo6

| ID | Sequence (5'->3') | Identity | mfeCode | mfeValue (kcal/mol) |
|---|---|---|---|---|
| BTX143000 (SEQ ID NO. 65002) | TCGGTGCACGGGAGTGAGC AGGTAGGGGCTCG | 0.71875 | (((.....)))...(((((........))))) | -6 |
| BTX183604 (SEQ ID NO. 105605) | CGTTGGTTTTGGCGAGTTG GGCGCGTGTGCGT | 0.71875 | ((((......))))......((((....)))) | -5.9 |
| BTX90485 (SEQ ID NO. 12487) | ATTTTGGCTCAATAGAGAC TCAGAGTGCGGCC | 0.71875 | ((((((((((....))).).)))))).... | -5.8 |
| BTX151550 (SEQ ID NO. 73552) | TTTGGGCTATGGGGTGCGC GAATGAGGCATTG | 0.71875 | ((((.((.........)).)))).... | -5.4 |

In total, 548 sequences had an identity score of 0.65 or higher as compared to Oligo6. The SEQ ID NOs. of these sequences ordered by identity to Oligo6 from high to low are 153288, 230810, 72324, 28200, 53868, 181518, 42357, 57489, 73227, 172055, 2952, 44405, 75929, 71429, 20006, 184108, 47784, 92897, 220240, 57283, 52420, 140995, 146820, 169084, 39855, 146442, 147185, 181215, 56691, 75368, 53201, 146451, 147211, 63615, 228278, 173786, 46890, 75306, 107324, 221968, 14758, 47455, 135584, 30860, 33832, 43355, 120959, 131982, 146257, 229669, 52947, 140895, 37532, 161060, 167186, 115635, 199581, 32146, 152683, 56718, 147067, 220159, 49808, 50500, 176682, 154788, 201850, 3316, 146032, 147160, 155055, 48737, 139597, 72670, 207849, 170684, 54938, 3636, 128263, 156447, 145935, 51375, 116222, 119142, 127442, 142254, 153286, 155023, 22541, 46005, 182785, 205662, 61165, 144596, 51275, 177954, 48823, 219645, 3084, 8721, 146275, 17565, 57305, 118912, 146989, 206013, 128221, 40437, 55270, 192802, 92525, 183937, 220230, 43550, 46880, 56462, 193987, 152961, 162432, 43249, 157821, 56686, 103350, 57509, 147179, 204595, 144580, 91355, 155573, 50702, 96578, 229726, 33377, 146294, 144529, 38645, 53968, 174050, 42652, 107918, 209673, 131257, 175795, 182083, 39709, 51680, 145326, 202876, 139743, 133866, 221057, 47843, 135884, 194660, 80602, 5151, 69290, 49106, 41372, 50054, 119798, 201995, 27833, 213489, 2552, 103757, 139126, 205965, 21565, 109594, 139143, 95213, 168594, 8295, 107746, 48633, 51565, 121759, 124806, 165297, 8858, 168415, 205374, 36291, 38832, 188342, 65224, 51894, 136891, 182808, 50398, 134134, 161741, 214580, 52534, 88648, 111909, 130891, 144347, 145899, 33191, 35279, 125042, 178432, 1128, 15284, 28047, 62081, 72359, 144383, 166893, 177544, 27186, 33119, 53848, 56247, 10318, 13463, 112272, 138972, 15079, 24082, 36118, 55252, 127295, 144690, 10788, 14263, 74803, 179469, 221824, 52269, 136543, 72810, 108106, 134688, 13605, 34744, 107781, 183957, 195805, 14823, 17943, 20827, 35634, 40892, 51368, 54007, 117928, 179645, 205008, 223768, 15354, 40102, 48730, 103308, 213735, 13491, 36202, 39617, 54305, 55719, 79126, 144251, 181386, 199426, 24145, 48970, 85613, 108868, 126137, 160451, 182602, 196198, 202593, 205100, 205178, 221276, 120234, 5534, 15236, 50585, 84864, 129328, 219741, 156356, 86591, 11670, 29721, 54364, 71545, 74815, 131589, 139261, 146096, 50285, 71392, 114854, 152931, 169999, 8242, 57478, 62417, 111260, 182506, 17688, 34796, 43260, 146362, 157911, 175343, 5282, 45570, 52948, 56261, 57527, 79678, 128070, 170101, 85036, 103923, 106792, 146449, 156276, 195604, 196920, 3796, 40839, 50916, 51342, 52751, 116864, 135801, 140220, 193642, 196275, 220855, 226649, 1694, 11775, 43184, 107072, 151999, 184762, 6175, 150549, 182543, 200143, 203039, 98018, 112499, 134073, 136233, 147188, 182640, 206111, 22684, 34862, 53055, 72815, 181471, 197260, 203774, 14892, 23173, 49134, 55035, 55769, 130459, 131392, 214574, 223101, 36256, 51551, 51755, 137626, 143652, 146917, 219821, 69499, 143367, 34770, 105892, 122539, 128264, 144806, 152945, 181300, 204421, 204755, 42340, 56630, 147194, 170809, 188435, 209724, 213559, 23949, 54193, 67388, 179249, 211115, 31368, 34502, 51837, 57080, 94239, 133863, 178270, 216886, 131090, 139144, 205199, 40207, 54308, 55444, 56625, 56828, 90681, 126395, 128352, 146092, 146416, 161065, 200089, 53369, 56071, 127939, 178282, 37651, 39118, 39693, 47389, 61289, 73185, 132055, 145917, 181354, 199583, 218281, 10820, 133779, 141303, 200009, 54698, 70129, 91825, 168148, 202370, 213819, 220132, 93335, 145481, 199400, 54628, 178071, 202831, 57710, 73719, 143175, 146419, 161948, 180016, 14543, 66627, 57374, 89825, 124215, 155543, 181422, 205448, 205630, 49108, 55482, 57015, 98225, 146453, 218426, 103338, 179980, 207727, 178323, 27665, 55329, 96775, 136240, 144944, 180598, 93933, 146163, 183627, 13029, 103967, 127930, 147087, 176958, 54661, 122836, 183775, 193643, 205616, 48939, 102882, 157197, 17752, 28989, 74331, 154261, 39112, 43618, 140934, 185185, 138825, 138909, 143865, 147257, 67515, 205974, 24649, 55488, 75948, 122503, 23338, 39818, 89053, 90410, 137944, 158565, 53667, 110669, 41983, 155574, 199831, 7910, 183865, 52679, 54099, 157927, 42198, 220071, 223787, 54235, 98792, 146366, 178495, 146625, 78716, 121036.

Aptamers with similar motifs are chosen and manufactured using the oligo synthesizer. The affinity of promising candidates is determined using SPR as in Example 3.

Example 5: Microvesicle-Based Aptamer Subtraction Assay

This Example presents a process of depleting an aptamer pool of aptamers that recognize biomarkers found in a biological sample. The method can be used to deplete aptamers that recognize microvesicles from healthy individuals. The depleted aptamers provide a pool of aptamers that can be screened against microvesicles from diseased individuals, thereby identifying aptamers that preferentially recognize disease versus healthy.

Aptamer Pool Subtraction

Circulating microvesicles are isolated from normal plasma (e.g., from individuals without cancer) using one of the following methods: 1) Isolation using the ExoQuick reagent according to manufacturer's protocol; 2) Ultracentrifugation comprising spin at 50,000 to 150,000 g for 1 to 20 hours then resuspending the pellet in PBS; 3) Isolation using the TEXIS reagent from Life Technologies according to manufacturer's protocol; and 4) filtration methodology. The filtration method is described in more detail as follows:

Place syringe and filter (1.2 μm Acrodisc Syringe Filter Versapor Membrane Non-Pyrogenic Ref: 4190, Pall Life Sciences) on open 7 ml 150K MWCO column (Pierce concentrators, 150K MWCO (molecular weight cut off) 7 ml. Part number: 89922). Fill open end of syringe with 5.2 ml of filtered 1×PBS prepared in sterile molecular grade water.

Pipette patient plasma (900-1000 μl) into the PBS in the syringe, pipette mix twice Filter the plasma into the 7 ml 150K MWCO column.

Centrifuge 7 ml 150K MWCO columns at 2000×g at 20° C. (16° C. to 24° C.) for 1 hour.

After 1 hour spin, pour the flow-through into 10% bleach to be discarded.

Visually inspect sample volume. If plasma concentrate is above the 8.5 ml graduation on the concentrator tube, continue to spin plasma sample at 10 minute increments at 2000×g at 20° C. (16° C. to 24° C.) checking volume after each spin until plasma concentrate is between 8.0 and 8.5 mls.

Pipette mix slowly on the column a minimum of 6 times and adjust pipette to determine plasma concentrate volume. If volume is between 100 μl and Target Volume, transfer plasma concentrate to previously labeled co-polymer 1.5 ml tube. If volume is still greater than Target Volume, repeat the above centrifugation step.

Pour ~45 mls of filtered 1×PBS prepared in sterile molecular grade water into 50 ml conical tube for use in the next step.

Add the appropriate amount of filtered 1×PBS to reconstitute the sample to the Target Volume.

The microvesicles produced using any of the isolation methods will comprise a mixture of vesicle types and will be various sizes with the exception of the ultracentrifugation methods, which tends to isolate exosomes.

Randomly generated oligonucleotides (produced as described in Example 1 above) are incubated with the isolated normal vesicles in PBS overnight at room temperature or at 4 degrees Celsius.

The aptamers that do not bind to these vesicles are isolated by spinning down the vesicles at 50,000 to 150,000×g for 1 to 20 hours and collecting the supernatant.

The aptamer oligonucleotides are collected from the supernatant by running the mixture over a column containing streptavidin-coated beads. These aptamers are then added to vesicles isolated from diseased patients (using the same methods as above) and incubated overnight in PBS at room temperature or 4 degrees Celsius.

The vesicles are then spun at 50,000 to 150,000×g for 1 to 20 hours and the supernatant is discarded. The vesicles are resuspended in PBS and lysed using SDS or some similar detergent.

The aptamers are then captured by running the lysis mixture over a column of streptavidin-coated beads. The isolated aptamers are then subjected to a round of PCR to amplify the products.

The process is then repeated for a set number of times, e.g., five or more times. The remaining aptamer pool has been depleted of aptamers that recognize microvesicles found in "normal" plasma. Accordingly, this method can be used to enrich the pool in aptamers that recognize cancer vesicles. See FIG. 6.

Example 6: Aptamer Target Identification

The Example above presents a method of identifying disease-specific aptamers. The Example further presents methods of identifying the targets of the disease-specific aptamers.

An aptamer identified according to the method in Example 5 is tethered to a microbead. The aptamer has shown the ability to preferentially recognize cancer vesicles versus controls. The microbead is incubated with a biological sample comprising cancer vesicles under conditions such that the aptamer can bind to the antigen it recognizes on the cancer microvesicle surface. Once the complex has formed, the aptamer is photo-crosslinked to the antigen. The vesicle is then disrupted using a surfactant, thereby leaving the aptamer-target complex tethered to the microbead. The microbeads are washed and recovered. The crosslinks are disrupted thereby releasing the target into solution. The beads are spun from solution and the target is further concentrated and isolated using size exclusion chromatography. The purified target is subjected to mass spectrometry for identification. See FIG. 14 for illustrative schematic.

Example 7: Illustrative Aptamer Sequences

The following Tables comprise illustrative aptamers of the invention. The aptamers were part of the pool of random aptamers described in Example 1. It is understood that the nucleotide sequences that are disclosed in Table 8 can be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to EpCAM antigen or functional fragments thereof. As used in the context of any defined numerical unit, the term "about" means variance of 10% above or below that numerical unit and all units in between. Modifications indicated in Table 8 were made to the aptamer pools in order to allow conjugation of the aptamer sequence. One of skill will appreciate that the thymine tail or similar moiety can be conjugated to either end of the aptamer.

TABLE 8

Illustrative EpCAM Aptamers

| Aptamer ID | Sequence | Modifications | SEQ ID NO. |
|---|---|---|---|
| BTX176881 | 5'-CCG CGC AGA TAT ACA ACG TAC CTC TGT | 3' tail comprising 6 | 98883 |

TABLE 8-continued

Illustrative EpCAM Aptamers

| Aptamer ID | Sequence | Modifications | SEQ ID NO. |
|---|---|---|---|
|  | GCG CA | thymines and a biotin moiety |  |
| BTX187269 | 5'-CTG TGA GGC GTA CTG CGG TGA GCC TCT CAT TA | 3' tail comprising 6 thymines and a biotin moiety | 109271 |
| BTX221708 | 5'-TGC AAG CTG CTA ATC AGC GAT GCT CTT TGG AG | 3' tail comprising 6 thymines and a biotin moiety | 143710 |
| APTAMER 4 | 5'-CCC CCC GAA TCA CAT GAC TTG GGC GGG GGT CG | 3' tail comprising 6 thymines and a biotin moiety | 1 |
| BTX222490 | 5'-TGC GCG TCT ATA AGT GCG CGA GCG GGC TTC CC | 3' tail comprising 6 thymines and a biotin moiety | 144492 |
| BTX196339 | 5'-GCG AGC CTA TGC ACC ATC TAG GTG TTG TGG CA | 3' tail comprising 6 thymines and a biotin moiety | 118341 |
| BTX214537 | 5'-TAT CGA TCG CAT CTA TGT GAT CGC TTA ACC GT | 3' tail comprising 6 thymines and a biotin moiety | 136539 |
| Aptamer 8 | 5'-AAT CGT TAG TCA CTA TTC GTC CAT AGT AGT GAC A | 3' tail comprising 6 thymines and a biotin moiety | 230811 |
| BTX201159 | 5'-GGC GGC GAC CAT TGT TGG TTT GGT GTC GCT GG | 3' tail comprising 6 thymines and a biotin moiety | 123161 |
| BTX219183 | 5'-TCG TGG CAA AGG CCG ATT CAC CCA TGC CGG GT | 3' tail comprising 6 thymines and a biotin moiety | 141185 |
| BTX80419 | 5'-ACA CGG GCC TTC TTG GCA CGA GCC ATG GGG CT | 3' tail comprising 6 thymines and a biotin moiety | 2421 |
| BTX145792 | 5'-TGC GTC ACT CTC GCG ATC AAG ATC ATT GAT CT | 3' tail comprising 6 thymines and a biotin moiety | 67794 |
| BTX135844 | 5'-GTT GCT GTC TAG CAA CGA CGC AAA CTG CAA CG | 3' tail comprising 6 thymines and a biotin moiety | 57846 |

TABLE 8-continued

Illustrative EpCAM Aptamers

| Aptamer ID | Sequence | Modifications | SEQ ID NO. |
|---|---|---|---|
| BTX85875 | 5'-AGC GGG GCA TCG GCG TTG GCG AAC CGA CGG CG | 3' tail comprising 6 thymines and a biotin moiety | 7877 |
| BTX120273 | 5'-GCC AGG CGT ATC CGC ATC CGA TGG GCT CGG GC | 3' tail comprising 6 thymines and a biotin moiety | 42275 |
| Aptamer 16 | 5'-TTT CAA GGC ACT CGT GTT CCC GAC ATG AGT G | 3' tail comprising 6 thymines and a biotin moiety | 230812 |
| BTX119687 | 5'-GCA TCG ATG CGT CCC CGC GGC GGC CAG CCG AT | 3' tail comprising 6 thymines and a biotin moiety | 41689 |
| BTX111579 | 5'-CTC GGT GCT GGA GTT TTG TAA CTC GCG TAC CG | 3' tail comprising 6 thymines and a biotin moiety | 33581 |
| Oligo6 | 5'-GGC GCA GGG GGG GGC CCA GAG TAT GGG GCC TG | 5' tail comprising 6 thymines and a biotin moiety | 230810 |
| BTX28596 (also referred to as Oligo4B) | 5'-GGC CGC GCA TTC TCT GCC GGC TGG TGT ACG GT | 5' tail comprising 6 thymines and a biotin moiety | 183132 |

Example 8: Detection of Microvesicles Using Anti-EpCAM Aptamers

Aptamers can be used as binding agents to detect a biomarker. In this Example, aptamers are used as binding agents to detect EpCAM protein associated with microvesicles.

FIGS. 18A-18D illustrate the use of an anti-EpCAM aptamer (Aptamer 4; SEQ ID NO. 1) to detect a microvesicle population in plasma samples. Plasma samples were obtained from three men with prostate cancer and three men without prostate cancer (referred to as controls or normals). Antibodies to the following microvesicle surface protein antigens of interest were conjugated to microbeads (Luminex Corp, Austin, Tex.): A) EGFR (epidermal growth factor receptor); B) PBP (prostatic binding protein; also known as PEBP1 (phosphatidylethanolamine binding protein 1)); C) EpCAM (epithelial cell adhesion molecule); and D) KLK2 (kallikrein-related peptidase 2). Microvesicles in the plasma samples were captured using the bead-conjugated antibodies. Fluorescently labeled Aptamer 4 was used as a detector in the microbead assay. FIGS. 18A-18D show the average median fluorescence values (MFI values) detected for the bead-captured and Aptamer 4 detected microvesicles. Each plot individually shows the three cancer (C1-C3) and three normal samples (N1-N3). These data show that, on average, the prostate cancer samples have higher levels of microvesicles containing the target proteins than the normals.

Example 9: Negative and Positive Selection of Aptamers

Aptamers can be used in various biological assays, including numerous types of assays which rely on a binding agent. For example, aptamers can be used instead of antibodies in immune-based assays. This Example provides an aptamer screening method that identifies aptamers that do not bind to any surfaces (substrates, tubes, filters, beads, other antigens, etc.) throughout the assay steps and bind specifically to an antigen of interest. The assay relies on negative selection to remove aptamers that bind non-target antigen components of the final assay. The negative selection is followed by positive selection to identify aptamers that bind the desired antigen.

Preliminary experiments were done with five DNA aptamer libraries with $10^{15}$ sequences each and variable lengths (60, 65, 70, 75, 80-mers) were pre-amplified and strand separated so that forward strand (non-biotinylated) serves as an aptamer. Multiple rounds of negative selection and positive selection were performed. Before each round, the recovered aptamer products were PCR amplified and strand separated using standard methodology.

The aptamer library and primers used to amplify the recovered aptamers after each round of selection are shown in Table 9. In the aptamer library sequences, 20N-40N refer to the number of random nucleotides in the library sequence.

TABLE 9

Aptamer Library and PCR Primers

| Identity | Sequence (5' -> 3') | SEQ ID NO. |
|---|---|---|
| Forward primer | 5'-ATCCAGAGTGACGCAGCA | 230813 |
| Forward primer | 5'-ACTAAGCCACCGTGTCCA | 230814 |
| Reverse primer | 5'-biotin-ATCCAGAGTGACGCAGCA | 230815 |
| Reverse primer | 5'-biotin-ACTAAGCCACCGTGTCCA | 230816 |
| 60-mer aptamer library | 5'-ATCCAGAGTGACGCAGCA-20n-TGGACACGGTGGCTTAGT | 230817 |
| 65-mer aptamer library | 5'-ATCCAGAGTGACGCAGCA-25n-TGGACACGGTGGCTTAGT | 230818 |
| 70-mer aptamer library | 5'-ATCCAGAGTGACGCAGCA-30n-TGGACACGGTGGCTTAGT | 230819 |
| 75-mer aptamer library | 5'-ATCCAGAGTGACGCAGCA-35n-TGGACACGGTGGCTTAGT | 230820 |
| 80-mer aptamer library | 5'-ATCCAGAGTGACGCAGCA-40n-TGGACACGGTGGCTTAGT | 230821 |

Selections were performed as follows:
Negative Selection

1. Prepare bead negative Selection Mix: Incubate 1200 non-magnetic beads with standard blocking agent for 20 min.
2. Add 50 µl of aptamer library (5 libraries total) to a PCR strip tube with 4.5 µl of each bead mixture. Incubate for 2 h at 37° C. with agitation at 550 rpm.
3. Pre-wet filter plate (1.2 m, Millipore) with PBS-BN buffer. Add 150 µl PBS-BN.
4. Transfer samples from the PCR strip tubes to the filter plate, incubate for 1 h at room temperature with agitation at 550 rpm.
5. Collect flow-through from filter plate into a collection (NBS) plate using a vacuum manifold.
6. Concentrate and clean samples to remove excess materials as desired.

The negative selection process is repeated up to 6-7 times.
Positive Selection

Before starting, conjugate the protein biomarkers of interest (SSX4, SSX2, PBP, KLK2, SPDEF) to desired non-magnetic microbeads using conditions known in the art. The recombinant purified starting material included: SPDEF recombinant protein from Novus Biologicals (Littleton, Colo., USA), catalog number H00025803-P01; KLK2 recombinant protein from Novus, catalog number H00003817-P02; SSX2 recombinant protein from Novus, catalog number H00006757-P01; PBP recombinant protein from Fitzgerald Industries International (Action, MA, USA), catalog number 30R-1382; SSX4 recombinant protein from GenWay Biotech, Inc. (San Diego, Calif., USA), catalog number GWB-E219AC.

1. Bead blocking: Incubate a desired number of each bead (8400×number of aptamer libraries (5)×an overage factor of (1.2)) with a starting block for 20 min.
2. Mix 50 µl of each aptamer library sample to PCR strip tubes add 2.3 µl of bead sample with particular antigen. Incubate for 2 h at 37° C. with agitation at 550 rpm.
3. Pre-wet filter plate (1.2 µm, Millipore) with PBS-BN buffer. Add 150 µl PBS-BN.
4. Transfer samples from the PCR strip tubes to the filter plate, incubate for 1 h at room temperature with agitation at 550 rpm.
5. Wash 3× with PBS-BN, add 50 µl of PBS and collect samples from the top of the filter to the 1.5 ml tubes.

The positive selection is repeated up to 16 times. Certain rounds of positive selection have additional steps to treat the recovered RNA (i.e., remaining aptamer candidates) as follows:

Round 8 of Positive Selection was Modified as Follows:
1. After the third wash (PBS-BN) 25 µl of sample were collected from the top of the filter into 1.5 ml tubes.
2. The filter plate was incubated at 45° C. for ~10 min and washed immediately using vacuum.
The plate was washed three more times with PBS-BN.
3. 50 µl of PBS were added to the plate and step 2 was repeated.
4. After the last wash, 25 µl of PBS was added to the wells. The samples were mixed well and collected from the top of the filter into 1.5 ml tubes.

Round 9 of Positive Selection was Modified as Follows:
1. After the final wash in step 5), 5 µg/ml Streptavidin-PE was added to the aptamer mixture and incubated for 30 min at room temperature with agitation at 550 rpm.
2. Samples on filter plate were washed 3× with PBS-BN (+additional 500 mM NaCl).
3. One additional wash with regular PBS-BN was performed.
4. 50 µl of PBS was added to the samples followed by collection as above into 1.5 ml tubes.
5. Samples stored at −20° C.

Round 14 of Positive Selection was Modified as Follows:
Before start this round, the antigens of interest (SSX4, SSX2, PBP, KLK2, SPDEF) were conjugated to carboxylated magnetic beads using methods known in the art.

1. Bead blocking: take desired number of each non-magnetic bead (3000× number of aptamer libraries (5)× an overage factor of 1.2), add starting block (3:1, blocking per 1200 beads), make 5 mixes of 4 antigens and supplement each with different target antigen conjugated to magnetic beads (see Table 10 below, wherein the antigens are conjugated to non-magnetic beads except as indicated), incubate 20 min.

TABLE 10

Bead blocking mixtures

| Blocking Mix | Non-magnetic bead antigens | Magnetic bead antigens |
|---|---|---|
| 1 | SSX4 + PBP + KLK2 + SPDEF | SSX2 |
| 2 | SSX2 + PBP + KLK2 + SPDEF | SSX4 |
| 3 | SSX2 + SSX4 + KLK2 + SPDEF | PBP |
| 4 | SSX2 + SSX4 + PBP + SPDEF | KLK2 |
| 5 | SSX2 + SSX4 + PBP + KLK2 | SPDEF |

2. Add 50 μl of aptamer libraries to PCR strip tubes, add bead mixtures with target antigen on magnetic beads to the tubes with pre-selected corresponding aptamer library and incubate for 2 h at 37° C. with agitation at 550 rpm.

3. Pre-wet filter plate with PBS-BN buffer, add 150 μl PBS-BN.

4. Transfer samples from PCR strip tubes to filter plate, incubate 1 h room temperature with agitation at 550 rpm.

5. After last (standard) wash, add 5 μg/ml Streptavidin-PE, incubate for 30 min room temperature with agitation at 550 rpm;

6. Wash 3× with PBS-BN (+additional 500 mM NaCl).

7. Perform one additional wash with regular PBS-BN.

8. 50 μl of PBS was added to the samples followed by collection as above into 1.5 ml tubes.

9. Remove the magnetic beads using a magnetic stand, and replace with fresh PBS buffer.

10. Samples stored at −20° C. for subsequent DNA extraction and strand separation.

Optional steps implemented in the later round of positive selection are intended to increase stringency of aptamer binding (e.g., increased heat or salt concentration).

Figure 19A:
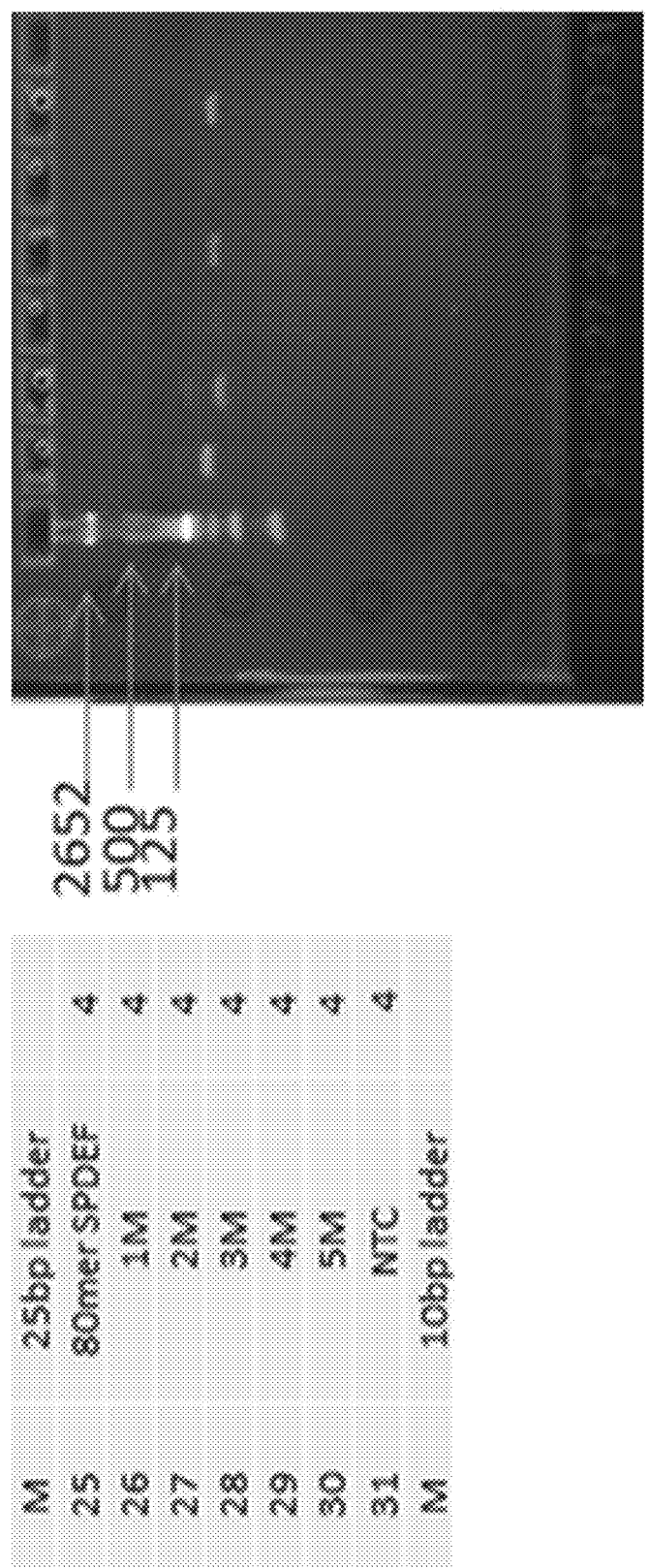
FIGS. 19A-19E illustrate selection of aptamers to antigens of interest. See Example 9. Five DNA aptamer libraries (labeled 1M-5M) after negative selection as described herein were incubated with mixture of 4 antigens (SSX2, SSX4, PBP, KLK2) conjugated to microbeads and supplemented with SPDEF antigen conjugated to magnetic beads. Samples were processed according to a positive section protocol as described herein. After collecting the magnetic beads, bound DNA aptamers were extracted from beads and re-amplified.
Figure 19B:
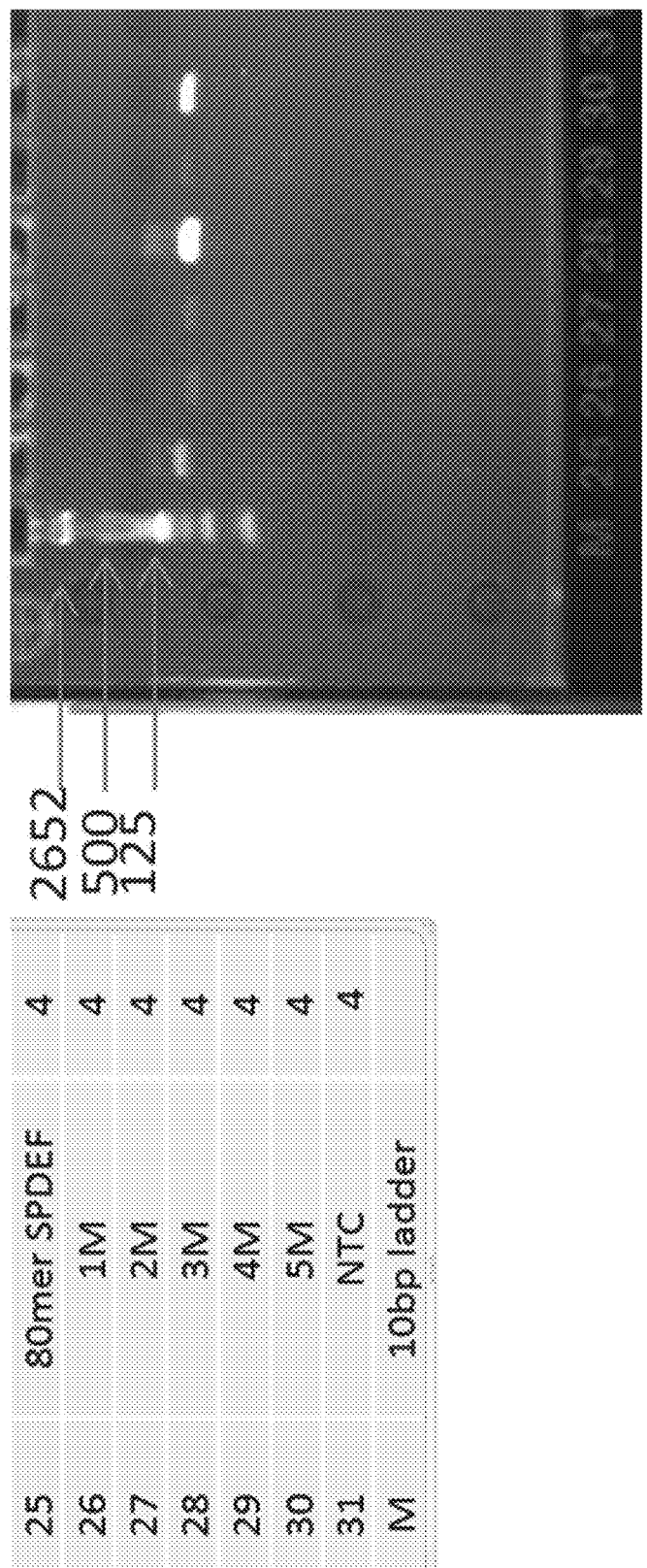
Figure 19C:
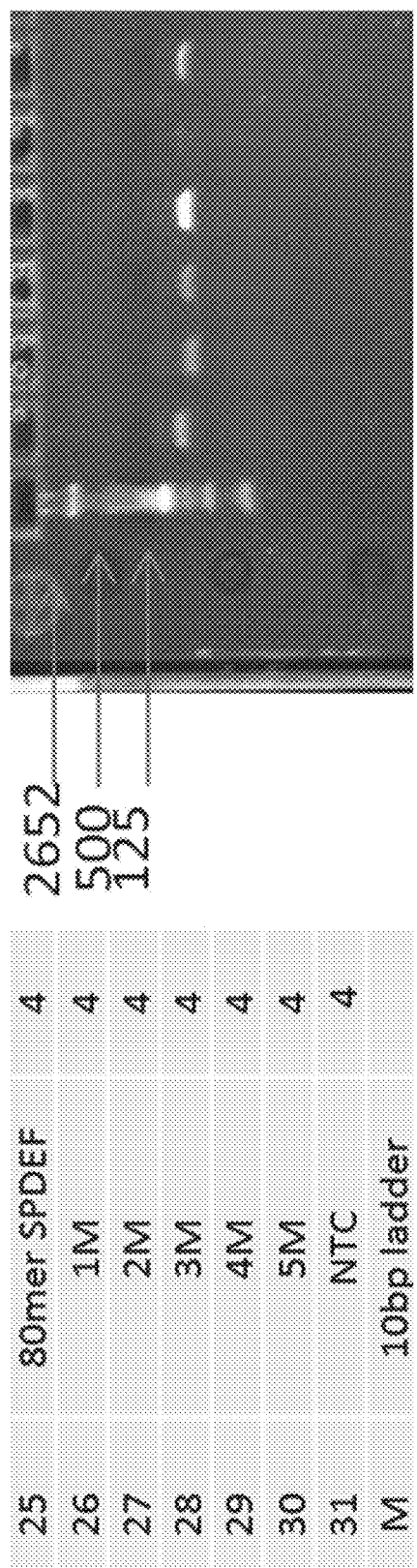

FIGS. 19A-19E illustrate selection of aptamers to antigens of interest during positive selection. Three rounds of negative selection had been performed previously. FIGS. 19A-19C illustrate five DNA aptamer libraries (labeled 1M-5M) selected for binding to SPDEF. After negative selection, the libraries were incubated with mixture of 4 antigens (SSX2, SSX4, PBP, KLK2) conjugated to microbeads and supplemented with SPDEF antigen conjugated to magnetic beads. Samples were processed according to the positive section protocol above. After collecting the magnetic beads, bound DNA aptamers were extracted from beads and re-amplified. FIGS. 19A-19C illustrate aptamers recovered from each starting library after one (FIG. 19A), two (FIG. 19B), and three rounds (FIG. 19C) of positive selection.

Figure 19D:
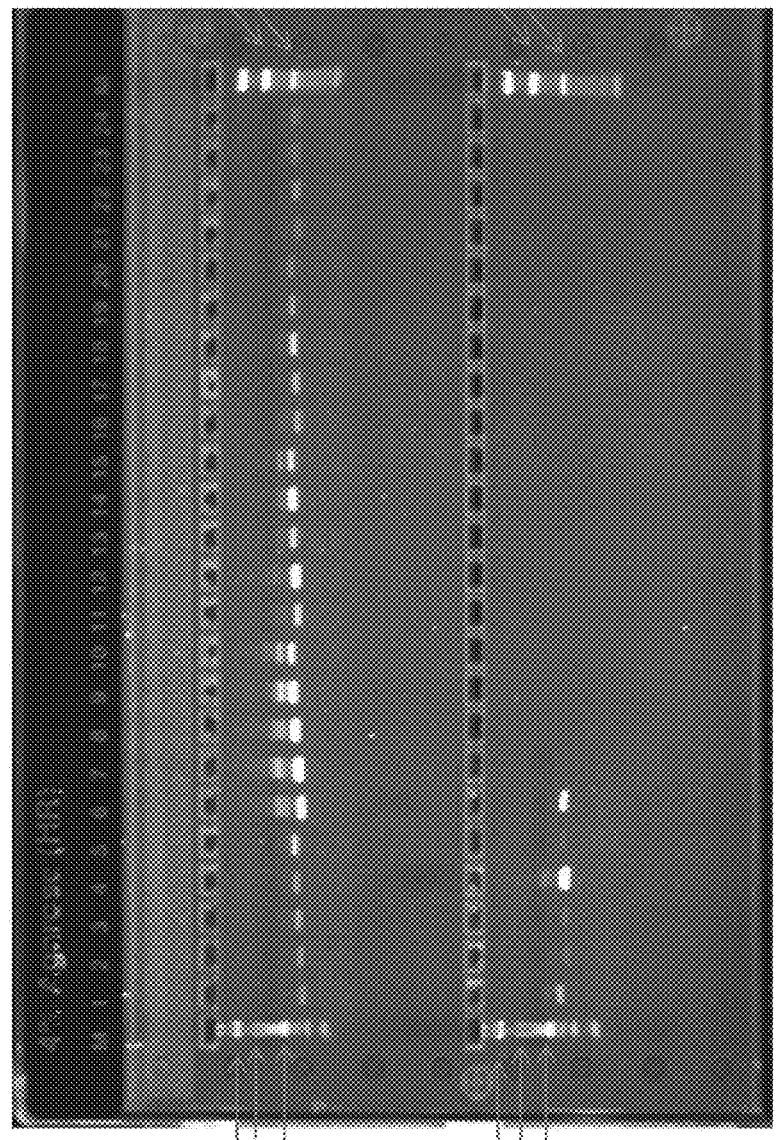
Figure 19E:
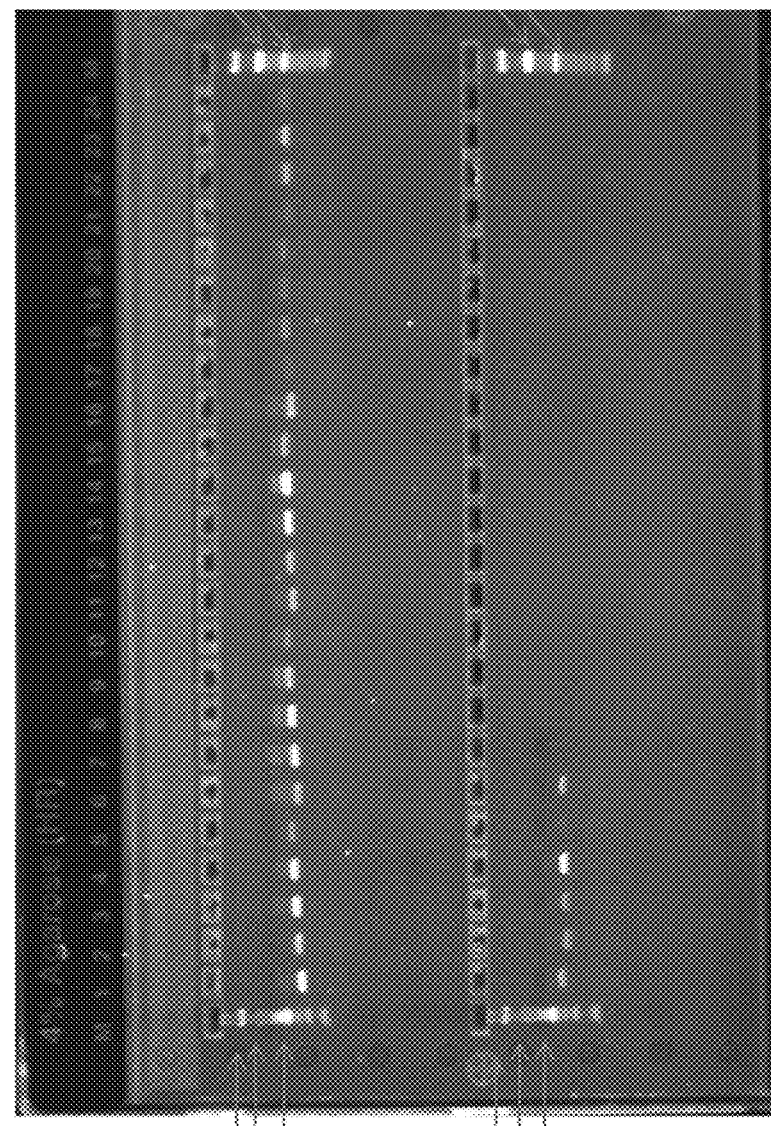

FIGS. 19D-19E illustrate screening 25 aptamer libraries after the 13th round of positive selection against specific antigen (5 libraries per each of SSX2, SSX4, PBP, KLK2 and SPDEF antigens). The aptamer selection after this round was modified with the inclusion of confounding antigens per the round 13 modifications described above. DNA aptamers bound to magnetic beads conjugated to the aptamers of interest were extracted from beads and re-amplified. The recovered libraries are shown in FIG. 19D. FIG. 19E shows the libraries after an addition round of selection and stringent wash.

Example 10: Strand Separation

After each round of selection in the Example above, the recovered aptamer pool was amplified using PCR with standard protocols. The PCR products were captured and strand separated using methodology presented in this Example.

Negative Selection Strand Separation

Prepare 20 μL/PCR of Streptavidin magnetic beads (Thermo Scientific, Rockford, Ill., USA) by placing on magnet for 1 min. Remove storage buffer completely. Wash 3 times with PBS-T. Resuspend in equivalent volume of PBS-T as at the start. Aliquot 20 μL/well in all relevant aptamer wells (25/plate) in a 96 well plate.

Add an additional 80 μL of PBS-T/well.

Add remaining PCR contents for each respective aptamer in appropriate well. Incubate at room temperature for 15 minutes with mild agitation. Place plates on magnet. Remove supernatant and discard. Wash 3× with 150 μL PBS.

After final wash, place on magnet and remove PBS. Add 50 μL of 0.1 M NaOH and incubate for 5 minutes at room temperature. Following the incubation, remove the strand-separated aptamer in solution and place in new 96-well leaving the complementary strand immobilized on the beads. Neutralize the solution with the addition of 5 μL of 1 M HCl. Bring volume up to 100 μL with 45 μL of water.

Ethanol precipitate by adding 1/10 volume of 3 M Sodium acetate pH 5.2 and 3× volumes of 95% ethanol.

Add 1.25 μL of glycogen (Roche 20 μg/μL) and spin at room temperature for 15 minutes. Discard supernatant and allow pellet to dry.

Resuspend in appropriate buffer for next round of selection.

Positive Selection Strand Separation

1. Aliquot each sample into a 1.7 ml Eppendorf tube.

2. Pre-aliquot into labeled tubes 5 μL 1M HCl. There should be one tube/sample.

3. If sample volume is ~38 μL, add 420 μL of 0.05% Tween in 1×PBS (to prepare add 250 μL of Tween into 500 mL of Hyclone PBS and mix well—pipet tween slowly—material is viscous).

4. Prepare streptavidin beads, 40 μL per sample is needed (keep beads pooled in a tube for washes). If performing 25 strand separations-aliquot 540 μL of beads×2 tubes (includes overage). Vortex beads well before preparing them, there should be no clumps evident.

5. Place beads on magnet and wait for the solution to clear.

6. Remove supernatant without disturbing the beads.

7. Add 1 mL 0.05% Tween in 1×PBS to the beads and mix off the magnet. Replace on the magnet after mixing and wait for the solution to clear.

8. Remove supernatant without disturbing the beads.

9. Repeat steps 7 and 8. Resuspend beads in tween-PBS solution in the same volume aliquoted previously 10. Vortex beads well off the magnet, and add 40 μL to each of the samples.

11. Cap the samples tightly and place on rotator for 15 minutes at room temperature.

12. Place samples back on the magnet to wash away unbound sample.

13. Add 1 mL 0.05% Tween in 1×PBS to each tube, aiming towards the magnetic wall. Wait for the solution to clear.
14. Remove supernatant without disturbing the beads.
15. Repeat steps 12 and 13. Make sure no remaining solution remains in the tube.
16. Off the magnet, add 50 μL of 0.1M NaOH to each sample.
17. Place tubes on Mix Mate for 5 minutes at 350 RPM room temperature.
18. After 5 minutes, place the tubes on the magnet.
19. After the beads clear and are stuck to the magnet, remove supernatant and add to appropriately labeled 5 μL HCl tubes (these should have been aliquoted and labeled prior to start of the strand separation). This should neutralize the solution. The solution should be slightly cloudy.
20. Bring the volume up to 100 μL in each tube by adding 45 μL of molecular grade RNase/DNase free water. Place samples briefly on ice.
21. Add 11 μL of 3M sodium acetate to each tube. This might clear some of the solution.
22. Add 350 μL of 95% ethanol to each tube.
23. Add 1.25 μL of glycogen to each tube, there should be a faint whitish trail that can be seen.
24. Mix by inversion 10×.
25. Centrifuge ethanol tubes for a minimum of 16 minutes at max speed at room temp.
26. When centrifugation is complete, remove ethanol from tubes, careful to not disturb the pellet. Use a p1000 first, followed up with a p200.
27. Let samples air dry for ~5 minutes or until ethanol residue is gone. Do not let air dry too long.
28. Resuspend samples in 55 μL 25 mM HEPES in PBS-BN.
29. Let sit for ~2 minutes and vortex sample and spin it down.
30. Aliquot 5 μl into tubes labeled with positive selection, the round number, date, sample number, and 'post-Amp'. Freeze at −20° C.
31. The remaining 50 μL is used for the next round of selection.

Example 11: Discovery and Characterization of Anti-EpCAM Aptamers

Figures 20A, 20B:
FIG. 20A illustrates the sequence of EPCAM aptamer CAR003 (SEQ ID NO. 230822).
FIG. 20B illustrates the optimal secondary structure of CAR003 with a minimum free energy ($\Delta G$) of −30.00 kcal/mol. For purposes of illustration, the aptamer is shown as an RNA aptamer (SEQ ID NO. 230847) corresponding to the DNA sequence in FIG. 20A.

In this Example, an aptamer to EpCAM identified using the technique in Examples 9-10 above is characterized. After selection for a pool of EpCAM binding aptamers as described above, the aptamer library was sequenced using the Ion Torrent standard protocol (Life Technologies, Carlsbad, Calif.). Lead candidates were selected as those having (a) high abundant motifs across all read sequences with full expected length product and (b) strong secondary structure (FIG. 20B).

Aptamers wre selected for EPCAM protein conjugated to MicroPlex beads in competition with SSX4, SSX2, PBP, KLK2, and SPDEF recombinant proteins. A portion of the aptamers was selected in initial rounds against EpCAM that was attached to an Fc tag, and after round 8 the selection was switched to EPCAM with a Histidine tag. Another portion of the aptamers was selected in initial rounds against EpCAM that was attached to a Histidine tag, and after round 8 the selection was switched to EPCAM with an Fc tag. Methods of using Fc and histidine tags for protein purification and capture are known to those of skill in the art. A number of representative sequences obtained from these procedures are shown in Table 11. In Table 11, the sequences are shown 5' to 3' from left to right, wherein each complete sequence consists of the indicated 5' leader sequence followed by the indicated Variable Sequence followed by the indicated 3' tail sequence. Each sequence is derived from a library having a leader and tail (see Table 9) with a variable sequence between. The table indicates whether the identified sequence comprises a biotin moiety on the 5' or 3' end. It is understood that the nucleotide sequences that are disclosed in Table 11 can also be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to EpCAM antigen or functional fragments thereof.

TABLE 11

EpCAM aptamer candidate sequences

| ID | SEQ ID NO. | 5'-Leader | Variable Sequence | Tail-3' |
|---|---|---|---|---|
| CAR003.2_5'-B | 230822 | Biotin-ATCCAGAGTGACGCAGCA | GTCTTTTCTGATGGACACGTGGTGGTCTAGTATC | TGGACACGGTGGCTTAGT |
| CAR003.2_3'-B | 230823 | ATCCAGAGTGACGCAGCA | GTCTTTTCTGATGGACACGTGGTGGTCTAGTATC | TGGACACGGTGGCTTAGT-Biotin |
| CAR008.2_5'-B | 230824 | Biotin-ATCCAGAGTGACGCAGCA | TCCCCCCCGATCCCCGACCATACCATGAATGTATTATCTT | TGGACACGGTGGCTTAGT |
| CAR008.2_3'-B | 230825 | ATCCAGAGTGACGCAGCA | TCCCCCCCGATCCCCGACCATACCATGAATGTATTATCTT | TGGACACGGTGGCTTAGT-Biotin |
| CAR009.2_5'-B | 230826 | Biotin-ATCCAGAGTGACGCAGCA | TAACCCGCAACCACCCATCACTGCCTGCTACTATA | TGGACACGGTGGCTTAGT |
| CAR009.2_3'-B | 230827 | ATCCAGAGTGACGCAGCA | TAACCCGCAACCACCCATCACTGCCTGCTACTATA | TGGACACGGTGGCTTAGT-Biotin |

TABLE 11-continued

EpCAM aptamer candidate sequences

| ID | SEQ ID NO. | 5'-Leader | Variable Sequence | Tail-3' |
|---|---|---|---|---|
| CAR010.2_5'-B | 230828 | Biotin-ATCCAGAGTGACGCAGCA | TGTGATGAGGGGGGTTTTCGATAGG | TGGACACGGTGGCTTAGT |
| CAR010.2_3'-B | 230829 | ATCCAGAGTGACGCAGCA | TGTGATGAGGGGGGTTTTCGATAGG | TGGACACGGTGGCTTAGT-Biotin |
| CAR011_5'-B | 230830 | Biotin-ATCCAGAGTGACGCAGCA | CCACCACCCGCCTACTGCTAGTTACTTGGGTAGTT | TGGACACGGTGGCTTAGT |
| CAR011_3'-B | 230831 | ATCCAGAGTGACGCAGCA | CCACCACCCGCCTACTGCTAGTTACTTGGGTAGTT | TGGACACGGTGGCTTAGT-Biotin |
| CAR012_5'-B | 230832 | Biotin-ATCCAGAGTGACGCAGCA | TTGGACCGGGGCTTGGCAATTTCGACCTAACATC | TGGACACGGTGGCTTAGT |
| CAR012_3'-B | 230833 | ATCCAGAGTGACGCAGCA | TTGGACCGGGGCTTGGCAATTTCGACCTAACATC | TGGACACGGTGGCTTAGT-Biotin |
| CAR013_5'-B | 230834 | Biotin-ATCCAGAGTGACGCAGCA | GGAGAGGGTGGCTTAGGGAGGTGCAAGAAGGTAGA | TGGACACGGTGGCTTAGT |
| CAR013_3'-B | 230835 | ATCCAGAGTGACGCAGCA | GGAGAGGGTGGCTTAGGGAGGTGCAAGAAGGTAGA | TGGACACGGTGGCTTAGT-Biotin |
| CAR014_5'-B | 230836 | Biotin-ATCCAGAGTGACGCAGCA | CATGCGGCATTCTGAGTCTGGTGCGACTTTCTGGT | TGGACACGGTGGCTTAGT |
| CAR014_3'-B | 230837 | ATCCAGAGTGACGCAGCA | CATGCGGCATTCTGAGTCTGGTGCGACTTTCTGGT | TGGACACGGTGGCTTAGT-Biotin |
| CAR015_5'-B | 230838 | Biotin-ATCCAGAGTGACGCAGCA | GATGAATTTGTATTTGGACGCGGTGGTGGTAATCA | TGGACACGGTGGCTTAGT |
| CAR015_3'-B | 230839 | ATCCAGAGTGACGCAGCA | GATGAATTTGTATTTGGACGCGGTGGTGGTAATCA | TGGACACGGTGGCTTAGT-Biotin |
| CAR016 | 230840 | Biotin-ACTAAGCCACCGTGTCCA | ACGTAAGTATATCTGTACAA | TGCTGCGTCACTCTGGAT |
| CAR017 | 230841 | Biotin-ACTAAGCCACCGTGTCCA | AACATCAGCTTTTATCTTAA | TGCTGCGTCACTCTGGAT |
| CAR018 | 230842 | Biotin-ACTAAGCCACCGTGTCCA | TGTTATAACCTACCATTAAA | TGCTGCGTCACTCTGGAT |
| CAR019 | 230843 | Biotin-ACTAAGCCACCGTGTCCA | ACCGTATGGTTATGTGCTCA | TGCTGCGTCACTCTGGAT |
| CAR020 | 230844 | Biotin-ACTAAGCCACCGTGTCCA | CCATACGTCACACTTCTTTA | TGCTGCGTCACTCTGGAT |
| CAR021 | 230845 | Biotin-ACTAAGCCACCGTGTCCA | GGTCCATCTCCTTACATTTT | TGCTGCGTCACTCTGGAT |

TABLE 11-continued

EpCAM aptamer candidate sequences

| ID | SEQ ID NO. | 5'-Leader | Variable Sequence | Tail-3' |
|---|---|---|---|---|
| CAR022 | 230846 | Biotin-ACTAAGCCACCGTGTCCA | CTATGTACCAACTATTTATA | TGCTGCGTCACTCTGGAT |

Additional aptamer candidates were chosen on the initial clonal screening and further validated on both Fc-EpCam and Histag Epcam target by titration of the aptamer and target EpCAM protein. A number of representative sequences obtained from these procedures are shown in Table 12. CAR027 and CAR028 were initially identified against Fc-EpCam target whereas CAR029 and CAR030 were initially identified against the Histag EpCam target. In Table 12, the sequences are shown 5' to 3' from left to right, wherein each complete sequence consists of the indicated 5' leader sequence followed by the indicated Variable Sequence followed by the indicated 3' tail sequence. Each sequence is derived from a library having a leader and tail (see Table 9) with a variable sequence between. The table indicates whether the identified sequence comprises a biotin moiety on the 5' or 3' end. Table 13 presents modified aptamer candidates based on the full sequences in Table 12. Rational for the modifications is listed in the table. The sequences are shortened to the extent that they retain the expected secondary structure. It is understood that the nucleotide sequences that are disclosed in Tables 12 and 13 can be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to EpCAM antigen or fragments thereof.

TABLE 12

Additional EpCAM aptamer candidate sequences

| ID | SEQ ID NO. | 5'-Leader | Variable Sequence | Tail-3' |
|---|---|---|---|---|
| CAR027 | 230904 | Biotin-ACTAAGCCACCGTGTCCA | GTGTCCCCTCCTATAGCTGC | TGCTGCGTCACTCTGGAT |
| CAR028 | 230905 | Biotin-ACTAAGCCACCGTGTCCA | GCGTTCCCCTACTATTTAAC | TGCTGCGTCACTCTGGAT |
| CAR029 | 230906 | Biotin-ACTAAGCCACCGTGTCCA | TCCTGGTTATACTCCCCTTC | TGCTGCGTCACTCTGGAT |
| CAR030 | 230907 | Biotin-ACTAAGCCACCGTGTCCA | TATCGCTGTTTCCTGTTATC | TGCTGCGTCACTCTGGAT |

TABLE 13

EpCAM aptamer optimization

| ID | SEQ ID NO. | 5'-Sequence-3' | Rational |
|---|---|---|---|
| CAR032 | 230909 | Biotin-TATCGCTGTTTCCTGTTATCTGCTGCG | Shorten the CAR030 sequence according to the secondary structure |
| CAR033 | 230910 | Biotin-TCCAGTGTCCCCTCCTATAGCTGCTGCTGCGTCACTCTGG | Shorten the CAR029 sequence according to the secondary structure |
| CAR034 | 230911 | Biotin-CCAGCGTTCCCCTACTATTTAACTGCTG | shorten the CAR028 sequence according to the secondary structure |

Aptamer Development

As an RNA aptamer, CAR003 with alternate tail sequence has the following RNA sequence (SEQ ID NO. 230847):

5'-auccagagug acgcagcagu cuuuucugau ggacacgugg uggucuagua ucacuaagcc accgugucca-3'

CAR003 (CAR003.2_5'-B, CAR003.2_3'-B) was further characterized. EpCAM aptamer CAR003 is modified as desired on the 3' end by attachment of a biotin moiety (CAR003.2_3'-B). The biotin can be used to bind the aptamer using a streptavidin-biotin system, e.g., for labeling, capture and/or anchoring. FIG. 20B illustrates the optimal secondary structure of CAR003 with a minimum free energy ($\Delta G$) of −30.00 kcal/mol. In the illustration, the aptamer is shown as an RNA aptamer (SEQ ID NO. 230847) corresponding to the CAR003 DNA sequence (SEQ ID NOs. 230822-230823).

Synthesis and Purification.

Figure 20C:
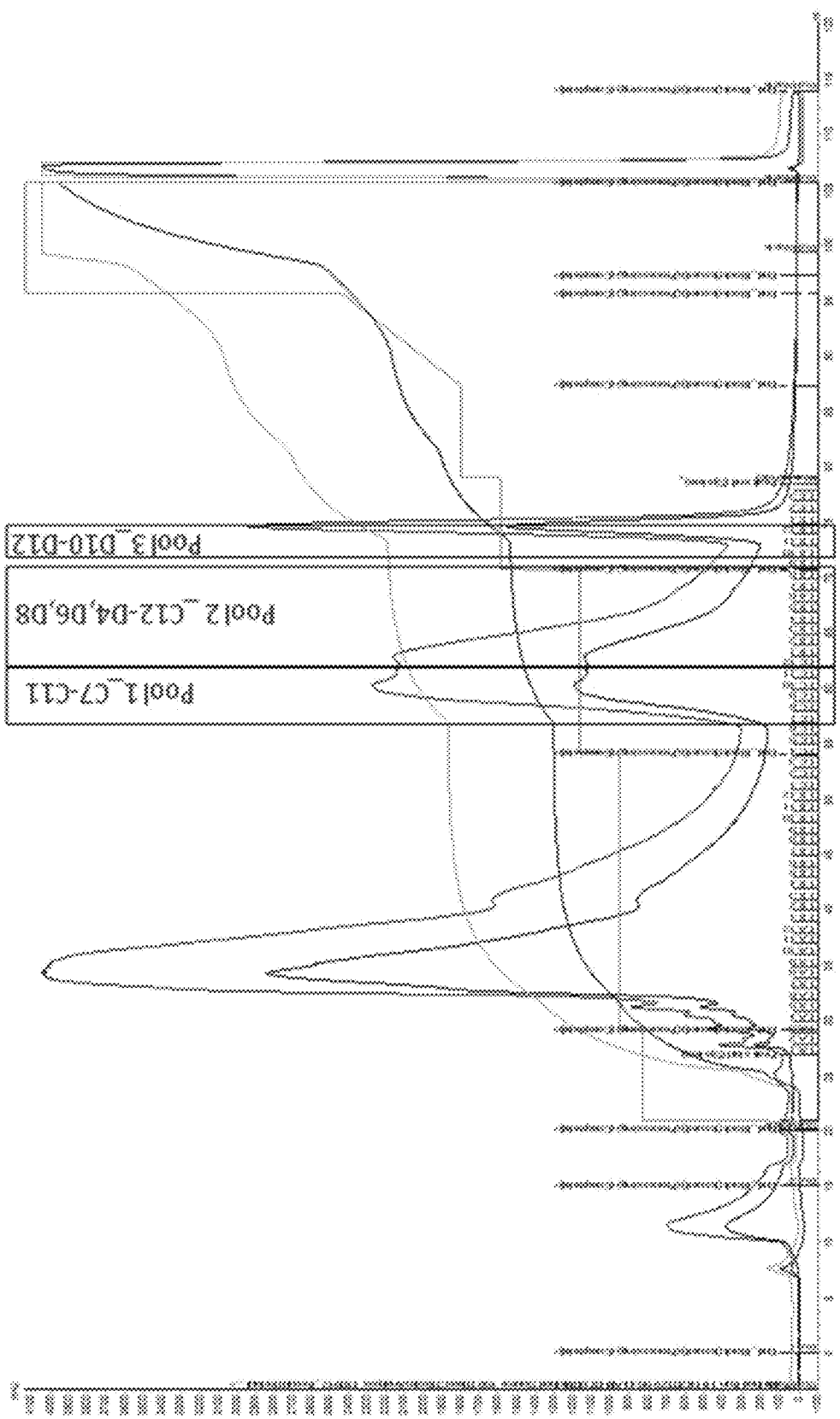
FIG. 20C illustrates aptamer pool purification. The figure comprises an FPLC chromatogram with all product and fractions assigned in pools after checking quality on gel.
Figure 20D:
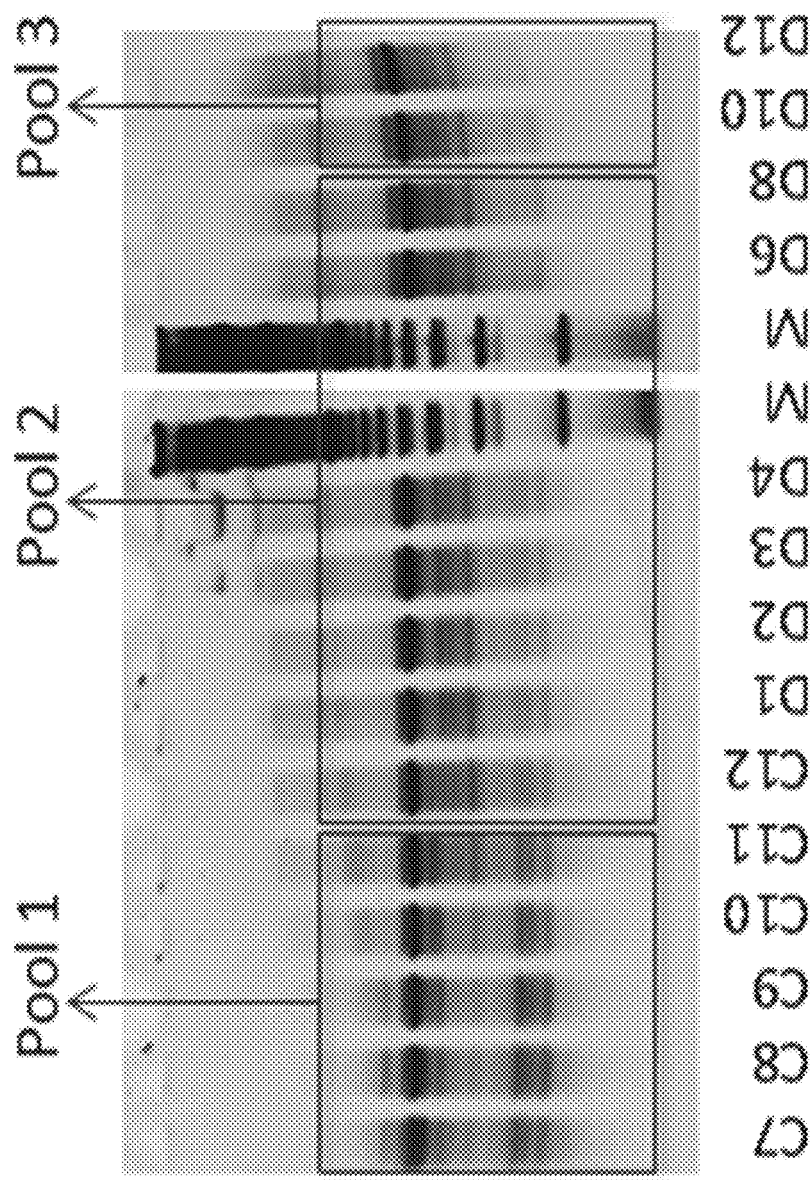
FIG. 20D illustrates a SYBR GOLD stained gel with different FPLC fractions of CAR003 aptamer after synthesis. Different fractions were combined in pools based on amount of un-finished chains in order high to low (pool 1-pool 3). The pools 1-3 correspond to those indicated in FIG. 20C.

The selected CAR003 aptamer was re-synthesized using AKTA OligoPilot 100 Synthesizer (GE Healthcare Life Sciences Corp., Piscataway, N.J.) with a 3'Biotin and final detritylation. The product was purified with anion exchange chromatography by FPLC. Several fractions after FPLC were combined as shown as the indicated Pools 1-3 in FIG. 20C. The figure comprises an FPLC chromatogram with all product and fractions assigned in pools after checking quality on gel. FIG. 20D illustrates a SYBR GOLD stained gel with different FPLC fractions of CAR003 aptamer after synthesis. Different fractions were combined in pools based on amount of unfinished chains in order high to low (pool 1-pool 3). The pools 1-3 correspond to those indicated in FIG. 20C.

CAR003 Aptamer Characterization.

Figure 20E:
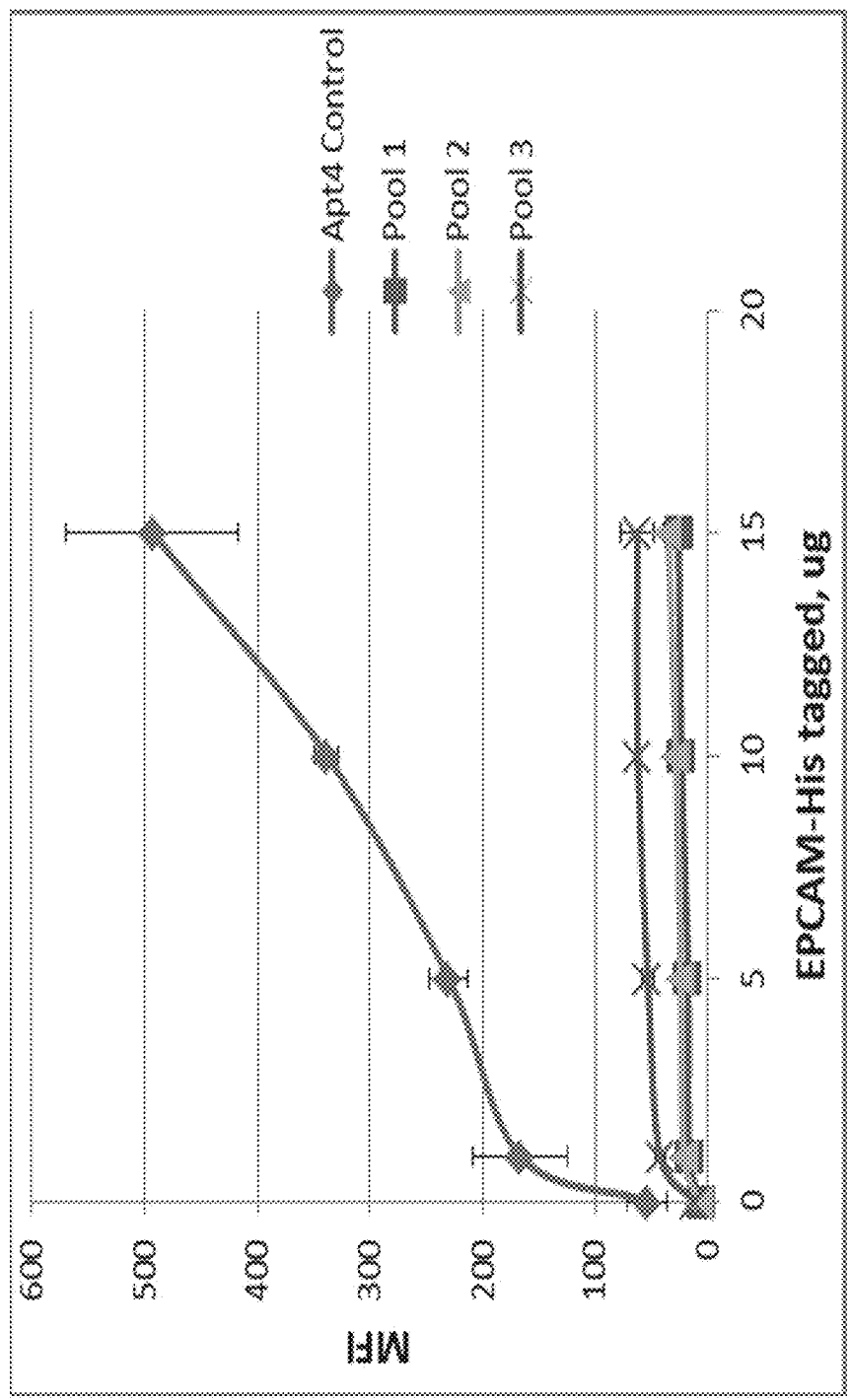
FIGS. 20E-F illustrate binding of CAR003 to EPCAM protein in 25 mM HEPES with PBS-BN (FIG. 20E) or in 25 mM HEPES with 1 mM $MgCl_2$ (FIG. 20F).
Figure 20F:
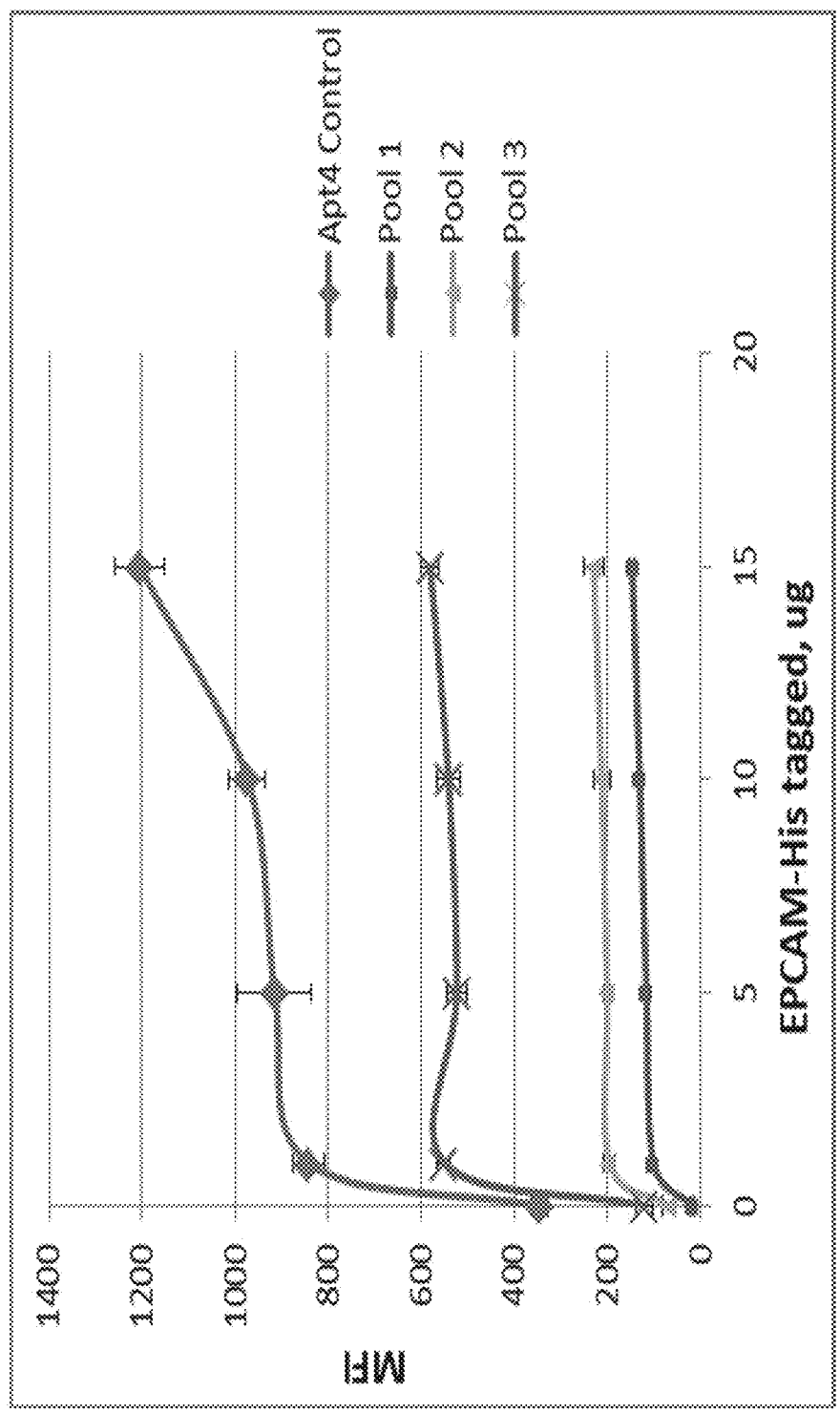

Purified CAR003 aptamer was tested for binding to recombinant EPCAM protein with a polyhistidine tag ("His tagged") using the following internally developed assay. Anti-His tag conjugated beads were mixed with EPCAM-His tagged protein. The aptamer to be tested was labeled with streptavidin-phycoerythrin (SA-PE). The EpCAM-beads and SA-PE labeled aptamers were mixed. Binding was determined as median flourescent value in a bead assay as described herein. MFI values (FIG. 20E-F) increase with increased binding of the SA-PE labeled aptamer to the recombinant EpCAM. FIGS. 20E-F illustrate binding of CAR003 to EPCAM protein in 25 mM HEPES with PBS-BN (PBS, 1% BSA, 0.05% Azide, pH 7.4) (FIG. 20E) or in 25 mM HEPES with 1 mM $MgCl_2$ (FIG. 20F). EPCAM aptamer Aptamer 4 (see above) was used for comparison. As shown in the figures, CAR003 pool 3 more efficiently binds its target in the presence of $MgCl_2$ (FIG. 20F) than in the presence of BSA (FIG. 20E).

Figure 20G:
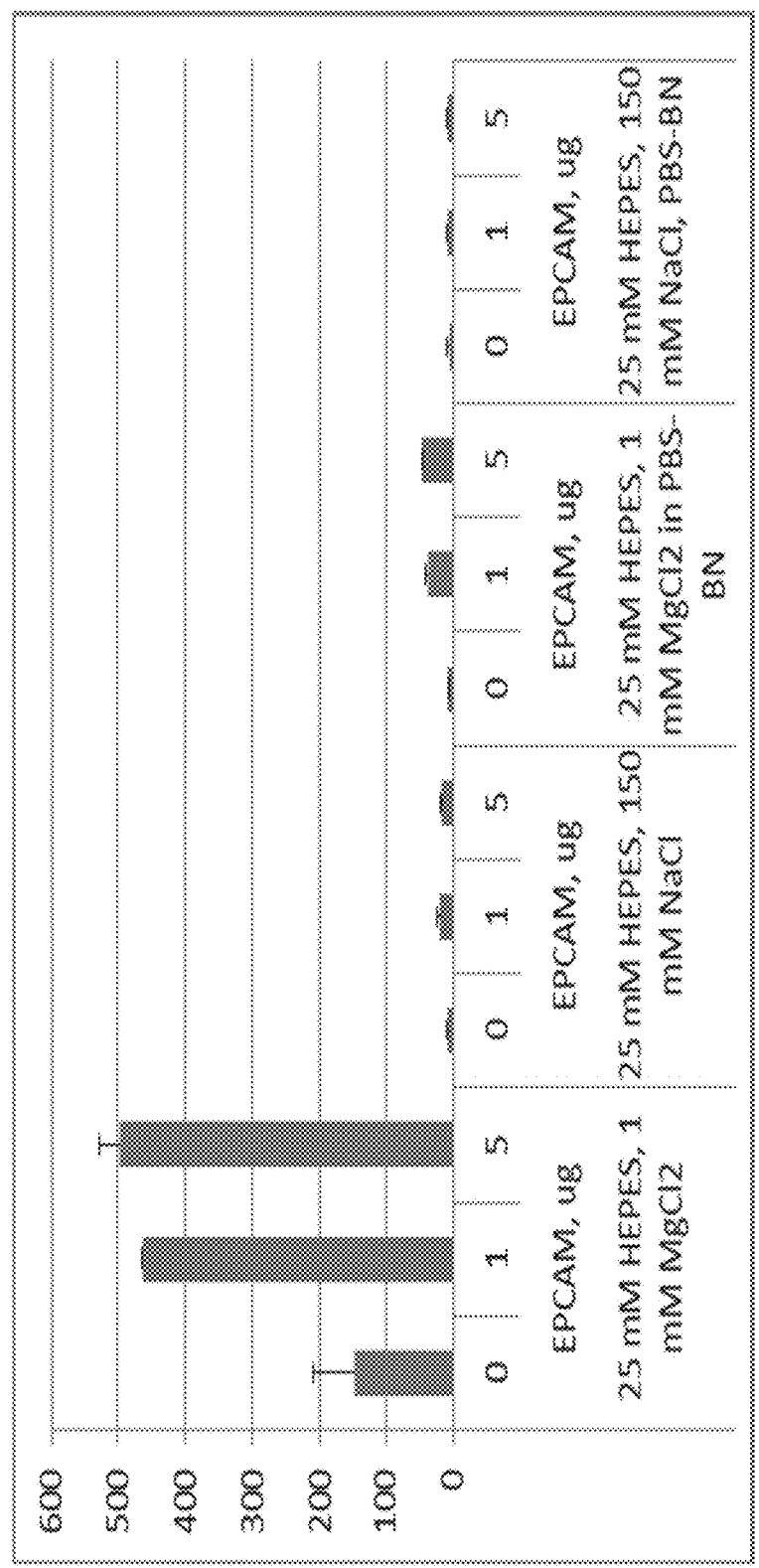
FIG. 20G illustrates CAR003 binding to EpCAM in the indicated salts with and without addition of bovine serum albumin (BSA).

To understand its performance further, CAR003 binding was tested in the presence of both BSA and $MgCl_2$ in various buffers. FIG. 20G illustrates CAR003 binding to EpCAM in the indicated salts with and without addition of bovine serum albumin (BSA). Again, CAR003 binding to EpCAM is more efficient when BSA is not present. Additionally, 150 mM NaCl was tested but did not appear to improve CAR003 performance over $MgCl_2$.

Figure 20H:
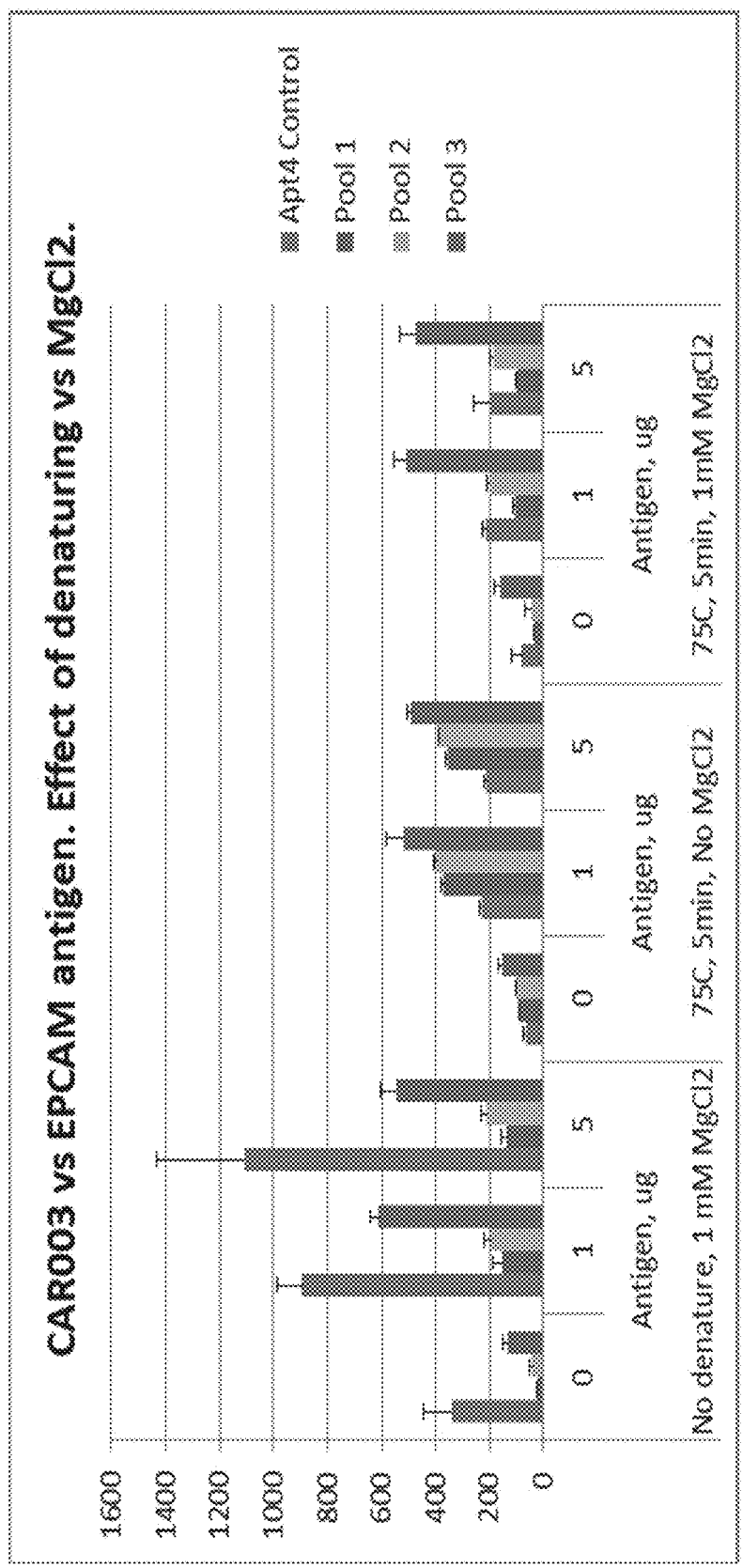
FIG. 20H illustrates the effect of denaturing on CAR003 binding to EPCAM protein. In each group of four bars, the aptamer is from left to right: Aptamer 4, CAR003 Pool 1, CAR003 Pool 2, CAR003 Pool 3.

Another factor which might influence performance of aptamer is denaturing with different salt compositions. FIG. 20H illustrates the effect of denaturing on CAR003 binding to EPCAM protein. As seen from the chart, denaturing of the aptamer has a postive effect on CAR003 binding to EpCAM similar as the effect on CAR003 from $MgCl_2$. However, denaturing in the presence of $MgCl_2$ may not synergistically improve binding of CAR003 to EpCAM. Interestingly, CAR003 appeared more stable compared to control Aptamer 4 in the conditions tested.

Figure 20I:
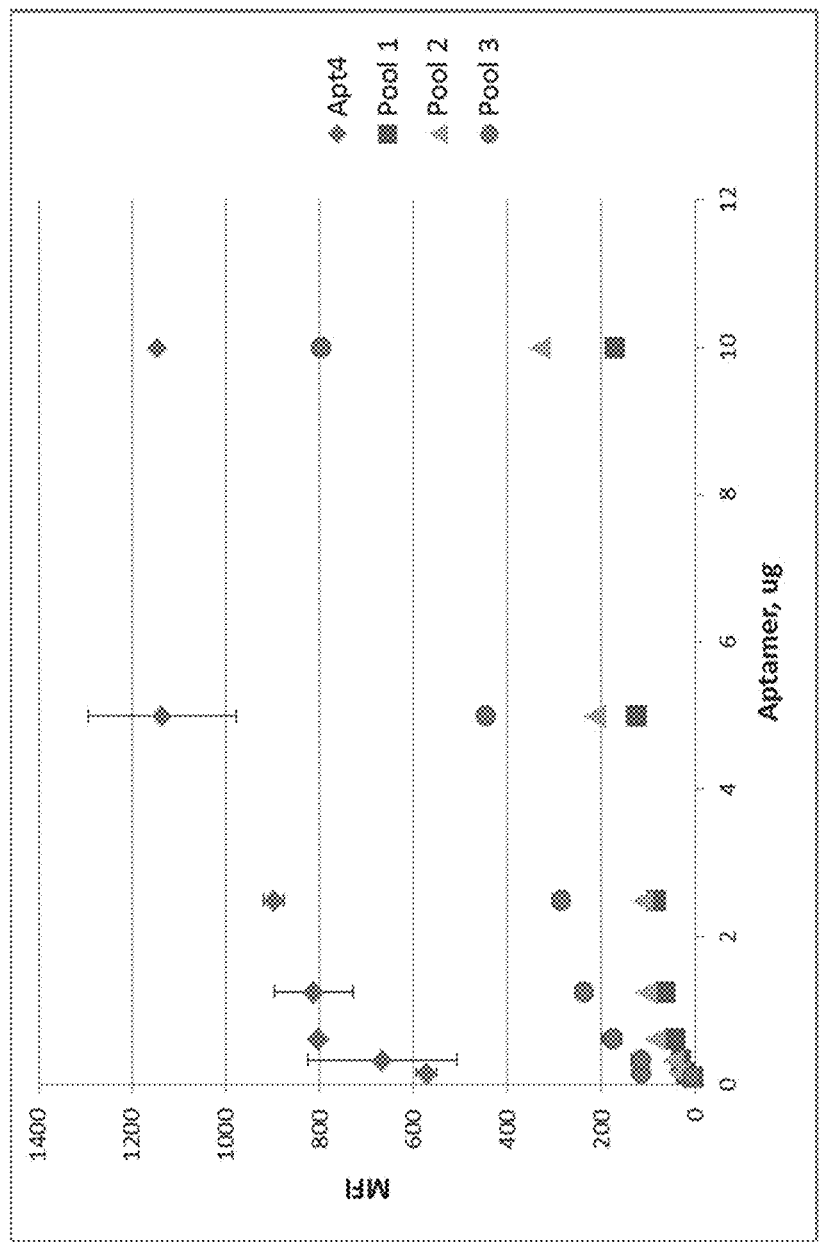
FIG. 20I illustrates titration of aptamers against EPCAM recombinant protein (constant input 5 μg).

CAR003 affinity to EpCAM in the bead assay environment was assessed in the same assay as above with aptamer titrated across a constant input of antigen. FIG. 20I illustrates titration of aptamers against EPCAM recombinant protein (constant input 5 fig). Under the conditions tested, Aptamer 4 had a higher affinity to EPCAM protein compared to CAR003 as suggested from saturation level starting at 5 μg of aptamer input.

Figure 20J:
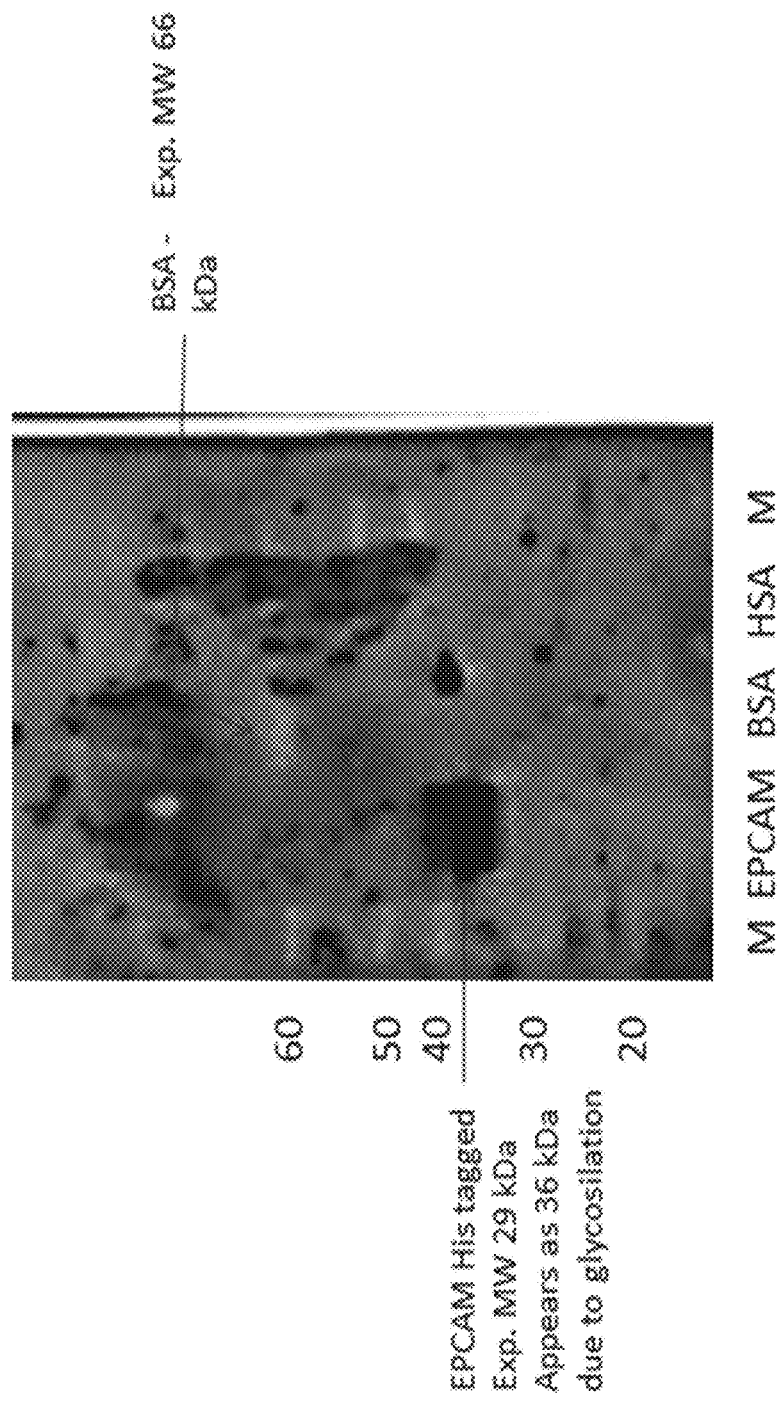
FIG. 20J illustrates a Western blot with CAR003 aptamer versus EPCAM his-tagged protein, BSA, and HSA (5 μg each). The gel was blocked 0.5% F127 and probed with ~50 μg/ml CAR003 biotinylated aptamer, fraction 3. The blot was visualized with NeutrAvidin-HRP followed by SuperSignal West Femto Chemiluminescent Substrate.
Figure 21A:
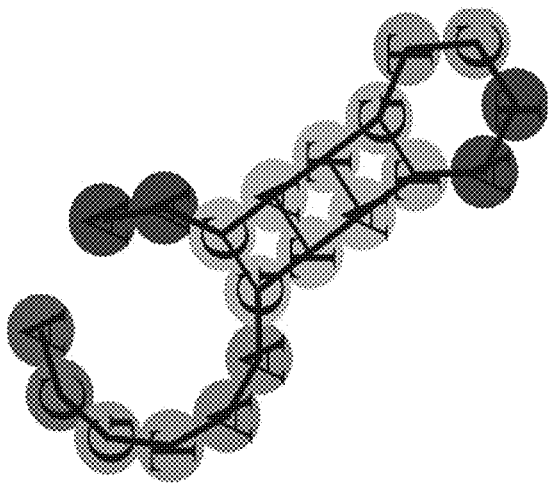
FIGS. 21A-21J show predicted secondary structure of CAR016 (SEQ ID NO. 230840) and indicated variants thereof.
Figure 21B:
Figure 21C:
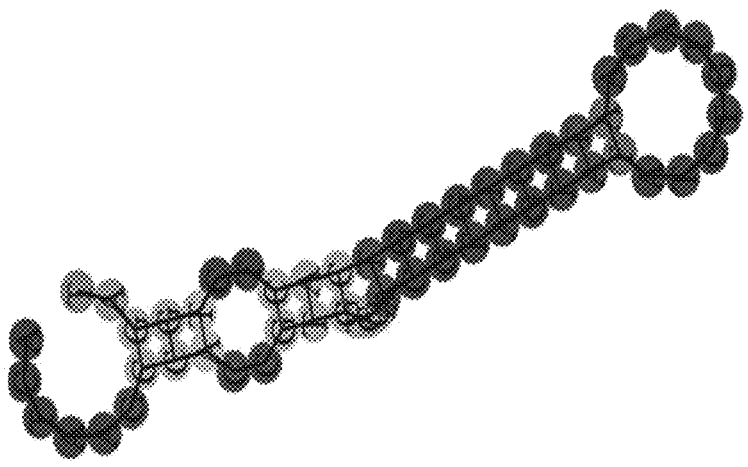
Figure 21D:
Figure 21E:
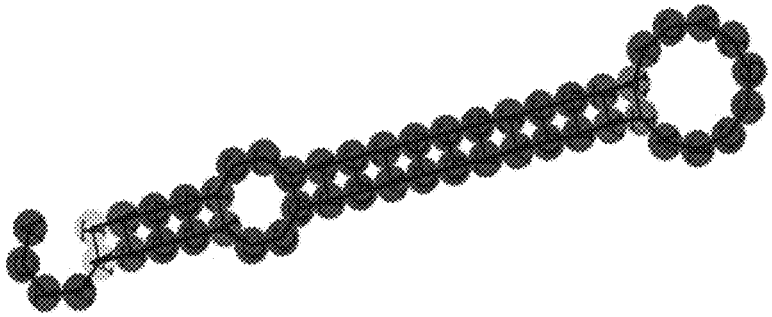
Figure 21F:
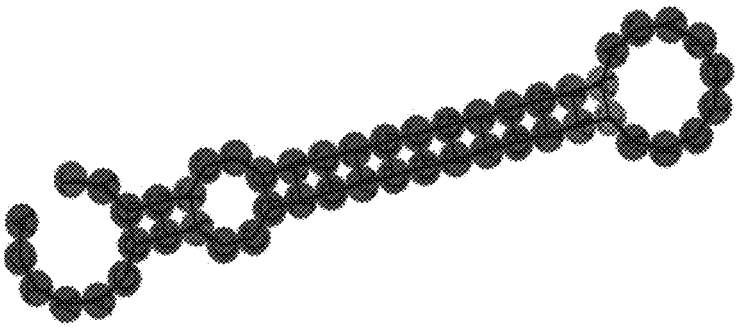
Figure 21G:
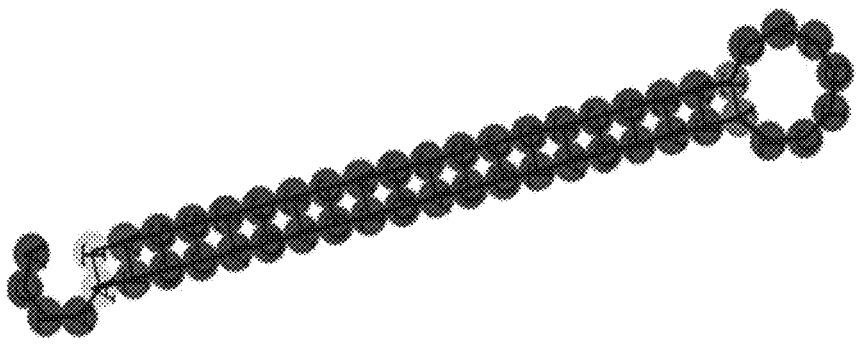
Figure 21H:
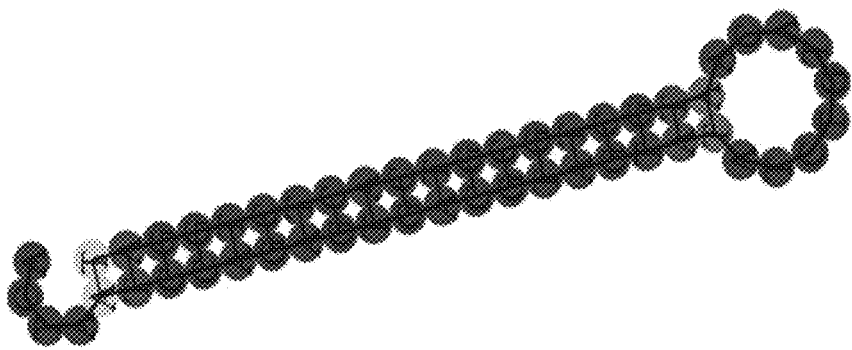
Figure 21I:
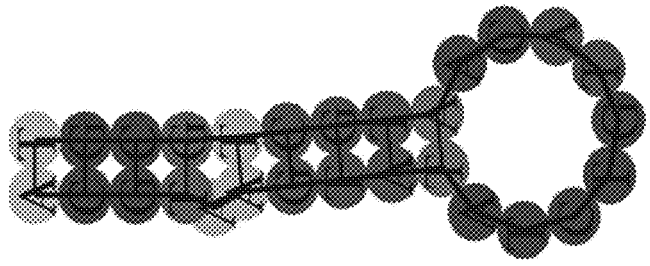
Figure 21J:
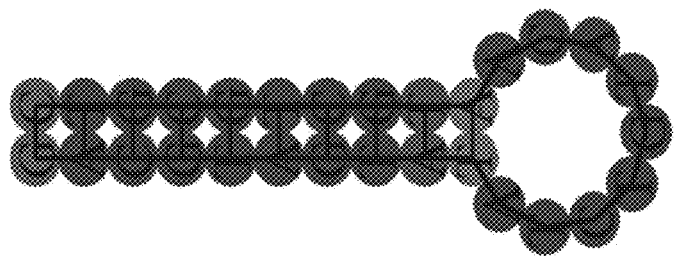

In order to evaluate specificity of CAR003, it was tested using Western Blot against EPCAM recombinant protein, and controls comprising bovine serum albumin (BSA) and human serum albumin (HSA). FIG. 20J illustrates a Western blot with CAR003 aptamer versus EPCAM his-tagged protein, BSA, and HSA (5 μg each). The gel was blocked 0.5% F127 and probed with ~50 μg/ml CAR003 biotinylated aptamer, fraction 3. The blot was visualized with NeutrAvidin-HRP followed by SuperSignal West Femto Chemiluminescent Substrate. The Western blot probed with CAR003 aptamer showed a clear preference of the aptamer to EPCAM protein over the albumins.

CAR003 Test with Plasma Samples.

Plasma samples from five prostate cancer and five normal subjects were tested with CAR003 to detect microvesicles using bead-conjugated proteins to capture the microvesicles and SA-PE labeled aptamer to detect the vesicles as described in Example 8. SA-PE labeled Aptamer 4 detector was used as control. Fold changes of Cancer over Normal are shown in Table 14. The fold changes are shown without normalization ("Raw") or with normalization to a negative control. The vesicles were captured with bead conjugated antibodies to SSX4, PBP, SPDEF, EPCAM, KLK2 and SSX2 as indicated.

TABLE 14

| | CAR003 to detect microvesicles | | | | | | |
|---|---|---|---|---|---|---|---|
| | | SSX4 | PBP | SPDEF | EPCAM | KLK2 | SSX2 |
| Raw | Standard protocol | 0.87 | 0.39 | 0.71 | 0.63 | 0.93 | 0.87 |
| | Incubation in presence of 1 mM MgCl2 and absence of PBS-BN | 0.77 | 0.39 | 0.69 | 0.6 | 0.91 | 0.81 |
| | Aptamer 4 control (standard protocol) | 0.78 | 0.67 | 0.81 | 0.72 | 1.19 | 0.79 |

TABLE 14-continued

| | CAR003 to detect microvesicles | | | | | | |
|---|---|---|---|---|---|---|---|
| | | SSX4 | PBP | SPDEF | EPCAM | KLK2 | SSX2 |
| Normalized to Negative control | Standard protocol | 1.49 | 0.84 | 1.13 | 1.17 | 1.5 | 1.38 |
| | Incubation in presence of 1 mM MgCl2 and absence of PBS-BN | 1.27 | 0.83 | 1.08 | 1.1 | 1.46 | 1.29 |
| | Aptamer 4 control (standard protocol) | 1.18 | 0.96 | 1.11 | 1.04 | 1.82 | 1.1 |

Under the conditions tested, the samples detected with CAR003 had lower MFI values as compared to detection with Aptamer 4, whereas CAR003 had a better signal-to-noise ratio and showed better separation between cancer and normal samples with SSX4, SPDEF, EPCAM and SSX2 capturing markers.

Control Aptamer

The characteristics of the aptamers (size, stability, binding affinity and specificity, etc) can be compared against control aptamers specific to EpCAM or other targets. For example, the aptamers are compared to the anti-VEGF aptamer 5' biotin-CA ATT GGG CCC GTC CGT ATG GTG GGT (SEQ. ID NO. 230912) as described in Kaur and Yung, 2012.

REFERENCES

1. Müller, J., et al. "Selection of high affinity DNA-aptamer for activated protein C using capillary electrophoresis." *Research in Pharmaceutical Sciences* 7.5 (2012): S987.
2. Cerchia, L., and V. de Franciscis. "Nucleic Acid Aptamers Against Protein Kinases." *Current medicinal chemistry* 18.27 (2011): 4152-4158.
3. Wu, Jie, et al. "Identification, Characterization and Application of a G-Quadruplex Structured DNA Aptamer against Cancer Biomarker Protein Anterior Gradient Homolog 2." *PloS ONE* 7.9 (2012): e46393
4. Mitkevich, Olga V., et al. "DNA aptamers detecting generic amyloid epitopes." *Prion* 6.4 (2012): 400-406.
5. Kaur H, Yung L-YL (2012) Probing High Affinity Sequences of DNA Aptamer against $VEGF_{165}$. PLoS ONE 7(2): e31196. doi:10.1371/journal.pone.0031196.

Example 12: Optimization of Anti-EpCAM Aptamers

This Example demonstrates optimization of aptamer CAR016 (SEQ ID NO. 230840), which is presented above. CAR016 was the most prevalent aptamer identified in several rounds of EpCAM aptamer selection as described above (see Example 9). Its variable sequence as shown above and sequences with common motifs represented over 50% of the selected aptamer pools. Table 15 shows the most common CAR016-related variants from two independent sequencing runs (Seq Run 1 and 2) using an Ion Torrent platform after 9 rounds of selection.

TABLE 15

| EpCAM aptamer screening representative sequences | | | | |
|---|---|---|---|---|
| ID | SEQ ID NO. | Variable Region 5'->3' | # Occurences Seq Run 1 | # Occurences Seq Run 2 |
| CAR016_VAR1 | 230848 | ACGTAAGTATATCTGTACAA | 92084 | 64506 |
| CAR016_VAR2 | 230849 | ACCGTATGGTTATGTGCTCA | 11104 | 8023 |
| CAR016_VAR3 | 230850 | ACGTAAGTATATCTGCACAA | 16 | 10 |
| CAR016_VAR4 | 230851 | ACCGTATGTTTATGTGCTCA | 14 | 4 |
| CAR016_VAR5 | 230852 | ACGTAAGTATATCTGTACAG | 12 | 11 |
| CAR016_VAR6 | 230853 | ACCGTAAGTATATCTGTACA | 10 | 8 |
| CAR016_VAR7 | 230854 | CCGTAAGTATATCTGTACAA | 8 | 0 |
| CAR016_VAR8 | 230855 | ACGTAAGTATATCTGTACAC | 7 | 0 |
| CAR016_VAR9 | 230856 | ATCGTAAGTATATCTGTACA | 5 | 3 |
| CAR016_VAR10 | 230857 | ACGTATGTATATCTGTACAA | 4 | 1 |
| CAR016_VAR11 | 230858 | ACGTAAGTATATGTGTACAA | 4 | 1 |
| CAR016_VAR12 | 230859 | AACGTAAGTATATCTGTACA | 4 | 9 |
| CAR016_VAR13 | 230860 | GCGTAAGTATATCTGTACAA | 3 | 1 |

TABLE 15-continued

EpCAM aptamer screening representative sequences

| ID | SEQ ID NO. | Variable Region 5'->3' | # Occurences Seq Run 1 | # Occurences Seq Run 2 |
|---|---|---|---|---|
| CAR016_VAR14 | 230861 | TCGTAAGTATATCTGTACAA | 2 | 1 |
| CAR016_VAR15 | 230862 | ACGTAAGTATATCTGTACAT | 2 | 9 |
| CAR016_VAR16 | 230863 | ACGTATGGTTATGTGCTCAA | 1 | 0 |
| CAR016_VAR17 | 230864 | ACGTAAGTATATCTGTTCAA | 1 | 1 |
| CAR016_VAR18 | 230865 | ACCGTATGGTTATCTGCTCA | 1 | 0 |
| CAR016_VAR19 | 230866 | AACGTATGGTTATGTGCTCA | 1 | 0 |
| CAR016_VAR20 | 230867 | GCCGTATGGTTATGTGCTCA | 0 | 2 |
| CAR016_VAR21 | 230868 | ACCGTATGGTTATGTGTTCA | 0 | 2 |
| CAR016_VAR22 | 230869 | ACGTAAGTATATCTGTTCAA | 0 | 1 |

Together, the sequences in Table 15 can be represented by the following sequence, where [AT] specifies that either an adenine (A) or thymine (T) is present: 5'-CGTA[AT] G [TG] [AT] TAT [CG] TG [TC] [AT] CA(ID CAR016_CAN; SEQ ID NO. 230870).

Testing via ELISA demonstrated that CAR016 bound to EpCAM-Fc in standard ELISA plates and to EPCAM-His tagged protein in Nickel coated ELISA plates. In microbead binding assays with microvesicle coated microbeads, CAR016 had the highest mean fluorescence values between all tested aptamer candidates, including Aptamer 4. Thus, a variety of variants of CAR016 were made to test for enhanced performance. The sequence variants are shown in Table 16 and the rational behind each variant is described in Table 17. "n/a" in Table 16 indicates that the section of the aptamer is not present. Underlined nucleotides in Table 16 indicate modified nucleotides as compared to CAR016. See Table 17 for further description. Certain mutations are made to examine the effects of aptamer stability as estimated by ΔG calculations. The estimated stability of CAR016 is ΔG=−10.89 kcal/mol. Lower ΔG indicates greater estimated stability. See in particular CAR016_M23 to CAR016_M27.

TABLE 16

EpCAM aptamer CAR016 mutant sequences

| ID | SEQ ID NO. | 5'-Leader | Variable Sequence | Tail-3' |
|---|---|---|---|---|
| CAR016_M1 | 230871 | Biotin-ACTAAGCCACCGTGTCCA | ACACAAGTATATCTGTACAA | TGCTGCGTCACTCTGGAT |
| CAR016_M2 | 230872 | Biotin-ACTAAGCCACCGTGTCCA | ACGTAAATATATCTGTACAA | TGCTGCGTCACTCTGGAT |
| CAR016_M3 | 230873 | Biotin-ACTAAGCCACCGTGTCCA | ACGTAAGTAGCGCTGTACAA | TGCTGCGTCACTCTGGAT |
| CAR016_M4 | 230874 | Biotin-ACTAAGCCACCGTGTCCA | ACGTAAGTATATCCATACAA | TGCTGCGTCACTCTGGAT |
| CAR016_M5 | 230875 | Biotin-ACTAAGCCACCGTGTCCA | ACGTAAGTATATCTGTATCA | TGCTGCGTCACTCTGGAT |
| CAR016_M6 | 230876 | Biotin-ACTAAGCCACCGTGTCCA | ACACAAATAGCGCCATATCA | TGCTGCGTCACTCTGGAT |
| CAR016_M7 | 230877 | Biotin-ACTAAGCCACCGTGTCCA | ACGTAAGTATATCTGTACAA | n/a |
| CAR016_M8 | 230878 | Biotin-ACTAAGCCACCGTGTCCA | AAAAAAGGGTCTTCTACGGT | TGCTGCGTCACTCTGGAT |

TABLE 16-continued

EpCAM aptamer CAR016 mutant sequences

| ID | SEQ ID NO. | 5'-Leader | Variable Sequence | Tail-3' |
|---|---|---|---|---|
| CAR016_M9 | 230879 | Biotin-ACTAAGCCACCGTGTCCA | ACGTA<u>C</u>GTATATCTGTACAA | TGCTGCGTCACTCTGGAT |
| CAR016_M10 | 230880 | Biotin-ACTAAGCCACCGTGTCCA | ACGTAAG<u>AC</u>TATCTGTACAA | TGCTGCGTCACTCTGGAT |
| CAR016_M11 | 230881 | Biotin-ACTAAGCCACCGTGTCCA | ACGTAAGTATAT<u>A</u>TGTACAA | TGCTGCGTCACTCTGGAT |
| CAR016_M12 | 230882 | Biotin-ACTAAGCCACCGTGTCCA | ACGTAAGTATATCTG<u>GC</u>CAA | TGCTGCGTCACTCTGGAT |
| CAR016_M13 | 230883 | n/a | Biotin-ACGTAAGTATATCTGTACAA | n/a |
| CAR016_M14 | 230884 | Biotin-CCGTGTCCA | ACGTAAGTATATCTGTACAA | TGCTGCGTC |
| CAR016_M15 | 230885 | ACTAAGCCACCGTGTCCA | ACGTAAGTATATCTGTACAA | TGCTGCGTCACTCTGGA-Biotin |
| CAR016_M16 | 230886 | n/a | Biotin-ACGTAAGTATATCTGTACAA | TGCTGCGTCACTCTGGAT |
| CAR016_M17 | 230887 | n/a | ACGTAAGTATATCTGTACAA | TGCTGCGTCACTCTGGAT-Biotin |
| CAR016_M18 | 230888 | Biotin-AC(dT-Biotin)AAGCCACCGTGTCCA | ACGTAAGTATATCTGTACAA | TGCTGCGTCACTCTGGAT |
| CAR016_M19 | 230889 | Biotin-AC(dT-Biotin)AAGCCACCG(dT-Biotin)GTCCA | ACGTAAGTATATCTGTACAA | TGCTGCGTCACTCTGGAT |
| CAR016_M20 | 230890 | Biotin-AC(dT-Biotin)AAGCCACCG(dT-Biotin)GTCCA | ACGTAAGTATATCTGTACAA | TGCTGCG(dT-Biotin)CACTCTGGAT |
| CAR016_M21 | 230891 | Biotin-AC(dT-Biotin)AAGCCACCG(dT-Biotin)GTCCA | ACGTAAGTATATCTGTACAA | TGCTGCG(dT-Biotin)CACTCTGGAT-Biotin |
| CAR016_M22 | 230892 | Biotin-ACTAAGCCACCGTGTCCA | ACGTAAGTATATCTGTACAA | TGCTGCGTCACTCTGGAT |
| CAR016_M23 | 230893 | Biotin-ACTAAGCCACCGTGTCCA | ACGTAGTATATCTGTACAA | TGCTGCGTCACTCTGGAT |
| CAR016_M24 | 230894 | Biotin-ACTAAGCCACCGTG | ACGTAGTATATCTGTACAA | TGCTGCGTCACTCTGGAT |
| CAR016_M25 | 230895 | Biotin-ACTAA<u>T</u>CCACCGTG | ACGTAGTATATCTGTACAA | TGCTGCGTCACTCTGGAT |
| CAR016_M26 | 230896 | Biotin-ACTAA<u>T</u>CCA<u>GA</u>GTG | ACGTAGTATATCTGTACAA | TGCTGCGTCACTCTGGAT |
| CAR016_M27 | 230897 | Biotin-ACTAA<u>T</u>CCA<u>GA</u>GTG | ACGTAGTATATCTGTAC<u>T</u>A | TGCTGCGTCACTCTGGAT |
| CAR016_M28 | 230898 | Biotin-G | ACGTAGTATATCTGTACAA | TGCTGCGTC |

TABLE 16-continued

EpCAM aptamer CAR016 mutant sequences

| ID | SEQ ID NO. | 5'-Leader | Variable Sequence | Tail-3' |
|---|---|---|---|---|
| CAR016_M29 | 230899 | n/a | Biotin-ACGTAAGTATATCTGTACAA | TGCTGCGT |

TABLE 17

EpCAM aptamer CAR016 mutant sequence rational

| ID | Explanation | Rational |
|---|---|---|
| CAR016_M1 | 3rd and 4th GT -> AC | Designed with substitutions in the constant motif |
| CAR016_M2 | 7th G ->A | sequence to challenge affinity in order to examine |
| CAR016_M3 | 10, 11 and 12th TAT -> GCG | the minimal effective sequence and assist in design |
| CAR016_M4 | 14 and 15th TG -> CA | proper negative control aptamers (e.g., similar to |
| CAR016_M5 | 18 and 19th CA -> TC | CAR016 but do not bind EpCAM). |
| CAR016_M6 | Mutations 1-5 combined | |
| CAR016_M7 | Truncated, no reverse primer | Designed to examine the role of reverse primer in aptamer affinity |
| CAR016_M8 | No abundant motif | Designed as negative control with no homology to abundant sequence |
| CAR016_M9 | 6th A -> C | Designed with substitutions in the variable motif |
| CAR016_M10 | 8th and 9th TA -> AC | sequence (see SEQ ID NO. 230870 above) to |
| CAR016_M11 | 13th C -> A | potentially improve affinity of aptamer. |
| CAR016_M12 | 15$^{th}$ & 16th TA -> GC | |
| CAR016_M13 | Truncated, no primers | Designed to examine the role of variable region in the aptamer affinity. Estimated $\Delta G = -0.7$ kcal/mol |
| CAR016_M14 | Truncated, minus 9 bases from both 5' and 3' | Designed to examine the role of both forward and reverse primers in aptamer affinity. Estimated $\Delta G = -5.6$ kcal/mol. |
| CAR016_M15 | 3'-Biotin | Designed to examine the impact of 3' biotinylation on aptamer affinity. |
| CAR016_M16 | Truncated, no forward primer | Designed to examine the role of forward primer in aptamer affinity. |
| CAR016_M17 | Truncated, no forward primer, 3'-Biotin | Designed as a control for M16 with 3' biotinylation |
| CAR016_M18 | 5' + Internal biotinylation at 3rd T | Designed in order to increase sensitivity of |
| CAR016_M19 | 5' + 2 Internal biotinylation at 3rd and 13th T | detection which will allow to minimize aptamer input in the assay and potentially boost the |
| CAR016_M20 | 5' + 3 Internal biotinylation at 3rd, 13th and 46th T | information capacity of the ouput data gathered with aptamer detection on plasma samples. |
| CAR016_M21 | 5', 3" + 3 Internal biotinylation at 3rd, 13th and 46th T | |
| CAR016_M22 | No spacer between Biotin and core sequence | Designed as negative control to standard biotinylation without spacer arm between Biotin and the core sequence. |
| CAR016_M23 | 5th A deleted in variable region of CAR016 | Designed in order to probe greater stability of secondary structure. Estimated $\Delta G = -14$ kcal/mol |
| CAR016_M24 | 15, 16, 17 and 18th TCCA deleted in forward primer of M23 | Designed in order to probe greater stability of secondary structure. Estimated $\Delta G = -20.5$ kcal/mol |
| CAR016_M25 | 6th G replaced with T in forward primer of M24 | Designed in order to probe greater stability of secondary structure. Estimated $\Delta G = -22.4$ kcal/mol |
| CAR016_M26 | 10, 11th CC replaced with GA in forward primer of M25 | Designed in order to probe greater stability of secondary structure. Estimated $\Delta G = -30.1$ kcal/mol |
| CAR016_M27 | 19th A replaced with T in variable region of M26 | Designed in order to probe greater stability of secondary structure. Estimated $\Delta G = -32.4$ kcal/mol |
| CAR016_M28 | 13 bases (5'->) truncated in FP, 9 bases (<- 3') truncated in RP in M24 | 2nd shortest stable aptamer. Estimated $\Delta G = -11.3$ kcal/mol |
| CAR016_M29 | CAR016 truncated: no FP; minus 9 bases at 3' in RP | The shortest stable aptamer which includes complete variable region. Estimated $\Delta G = -4.6$ kcal/mol |

As observed in Tables 16 and 17, various modifications are made across the length of the aptamers, including the 5'-leader and 3'-tail primer sequences. The aptamer variants are synthesized and binding to EpCAM is assessed using ELISA and microbead assay as described above for CAR016. Results reveal regions of the aptamer sequence that enhance or degrade the ability of the aptamer to bind specifically to EpCAM protein and EpCAM+ microvesicles. FIGS. 21A-21J show predicted secondary structures of CAR016 and the indicated CAR016 variants in Tables 16 and 17.

Example 13: Aptamers to VCAP Microvesicles

In this Example, aptamers were identified that recognize microvesicles shed by the prostate cancer VCAP cell line. VCAP microvesicles were coated onto a standard ELISA plate with a high-binding surface. After washing excess unbound microvesicles from the wells, the wells were blocked with Pluronic® F-127 (Sigma Aldrich). A 20n aptamer library (see Table 9) was incubated with the well-bound microvesicles. The wells were washed to remove unbound aptamers. The remaining VCAP microvesicles aptamers were eluted, purified, amplified, and strand separated and cleaned before next round. See detailed methodology above. The previous steps were repeated for 8 rounds. After round 8, the selected aptamer pool was subjected to IonTorrent sequencing.

Aptamers having the top frequency between total reads are shown in Table 18. In Table 18, the sequences are shown 5' to 3' from left to right, wherein each complete sequence consists of the indicated 5' leader sequence followed by the indicated Variable Sequence followed by the indicated 3' tail sequence. Each sequence is derived from a library having a leader and tail (see Table 9) with a variable sequence between. The table indicates whether the identified sequence comprises a biotin moiety on the 5' or 3' end. It is understood that the nucleotide sequences that are disclosed in Table 18 can also be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to vesicle antigens or functional fragments thereof.

TABLE 18

VCAP microvesicle aptamer sequences

| ID | SEQ ID NO. | 5'-Leader | Variable Sequence | Tail-3' |
|---|---|---|---|---|
| CAR023 | 230900 | Biotin-ACTAAGCCACCGTGTCCA | TCTTTCGTCTTGTTATGTAT | TGCTGCGTCACTCTGGAT |
| CAR024 | 230901 | Biotin-ACTAAGCCACCGTGTCCA | TGTTTTCCTTCTTACCTTTA | TGCTGCGTCACTCTGGAT |
| CAR025 | 230902 | Biotin-ACTAAGCCACCGTGTCCA | ACCTACTATCCATTAATTTT | TGCTGCGTCACTCTGGAT |
| CAR026 | 230903 | Biotin-ACTAAGCCACCGTGTCCA | ATGTTTTCCCTGTTATTTTT | TGCTGCGTCACTCTGGAT |
| CAR031 | 230908 | Biotin-ACTAAGCCACCGTGTCCA | CCTATTATTAGCTTTTCTTT | TGCTGCGTCACTCTGGAT |
| CAR035 | 230913 | Biotin-ACTAAGCCACCGTGTCCA | TAACACTATGTCAGTTAGTA | TGCTGCGTCACTCTGGAT |
| CAR036 | 230914 | Biotin-ACTAAGCCACCGTGTCCA | CTTGAAATGTGATTCTTTAT | TGCTGCGTCACTCTGGAT |
| CAR037 | 230915 | Biotin-ACTAAGCCACCGTGTCCA | TTCCTTGTCTCCTATTCATT | TGCTGCGTCACTCTGGAT |
| CAR038 | 230916 | Biotin-ACTAAGCCACCGTGTCCA | TCTCTATATTACATGCTTCT | TGCTGCGTCACTCTGGAT |
| CAR039 | 230917 | Biotin-ACTAAGCCACCGTGTCCA | CCCTTTTTGCGATTTCTTTA | TGCTGCGTCACTCTGGAT |
| CAR040 | 230918 | Biotin-ACTAAGCCACCGTGTCCA | GAAGTAAGATCCTTCTGATA | TGCTGCGTCACTCTGGAT |
| CAR041 | 230919 | Biotin-ACTAAGCCACCGTGTCCA | ACCTTGTTGTATCCGTTATA | TGCTGCGTCACTCTGGAT |

TABLE 18-continued

VCAP microvesicle aptamer sequences

| ID | SEQ ID NO. | 5'-Leader | Variable Sequence | Tail-3' |
|---|---|---|---|---|
| CAR042 | 230920 | Biotin-ACTAAGCCACCGTGTCCA | TTGCCTTTTCAAAGTAATAT | TGCTGCGTCACTCTGGAT |
| CAR043 | 230921 | Biotin-ACTAAGCCACCGTGTCCA | TATTCCCATGTCATATACCT | TGCTGCGTCACTCTGGAT |
| CAR044 | 230922 | Biotin-ACTAAGCCACCGTGTCCA | TTGCATAGCATATTATCTTC | TGCTGCGTCACTCTGGAT |
| CAR045 | 230923 | Biotin-ACTAAGCCACCGTGTCCA | TTGTTACTCTGTATCTTTAT | TGCTGCGTCACTCTGGAT |
| CAR046 | 230924 | Biotin-ACTAAGCCACCGTGTCCA | TTCTTTACTCTTTTCTTTTT | TGCTGCGTCACTCTGGAT |
| CAR047 | 230925 | Biotin-ACTAAGCCACCGTGTCCA | TCGTTTCTTCTTCACTTTAT | TGCTGCGTCACTCTGGAT |
| CAR048 | 230926 | Biotin-ACTAAGCCACCGTGTCCA | TGTTTCCTTCTGTTATCTTA | TGCTGCGTCACTCTGGAT |
| CAR049 | 230927 | Biotin-ACTAAGCCACCGTGTCCA | TTCTCTTGCTCTCTTTCTCT | TGCTGCGTCACTCTGGAT |

The sequences in Table 18 were the most commonly represented in the sequencing pool with two independent sequencing runs. Highest frequencies were: 1) CAR023, 18.3%; 2) CAR024, 12.7%; 3) CAR025, 9.8%; and 4) CAR026, 8.8%. CAR031 was the 5$^{th}$ most common sequence. Sequences were further validated by titration of the aptamers and target VCap exosomes.

The aptamers in Table 18 are also directly modified with a label instead of the 5' biotin moiety. For example, the biotin may be substituted with a 5' digoxigenin (NHS Ester) (abbreviated as "/5DigN/"). The digoxigenin group provides a fluorescent label. The 5' digoxigenin may be separated from the nucleotide sequence with a spacer, e.g., Int Spacer 18 (abbreviated as "/Int18/"), which is an 18-atom hexaethyleneglycol spacer and is available from Integrated DNA Technologies (IDT). Similar spacers also available from IDT which can be used include: 1) C3 Spacer, a phosphoramidite that can be incorporated internally or at the 5'-end of the oligo. Multiple C3 spacers can be added at either end of an oligo to introduce a long hydrophilic spacer arm for the attachment of fluorophores or other pendent groups; 2) PC (Photo-Cleavable) Spacer can be placed between DNA bases or between the oligo and a 5'-modifier group. It offers a 10-atom spacer arm which can be cleaved with exposure to UV light in the 300-350 nm spectral range. Cleavage releases the oligo with a 5'-phosphate group; 3) Hexanediol is a six carbon glycol spacer that is capable of blocking extension by DNA polymerases. This 3' modification is capable of supporting synthesis of longer oligos; 4) Spacer 9 is a triethylene glycol spacer that can be incorporated at the 5'-end or 3'-end of an oligo or internally. Multiple insertions can be used to create long spacer arms; and 5) The 1',2'-Dideoxyribose (dSpacer) modification is used to introduce a stable abasic site within an oligonucleotide.

Example 14: Aptamer Target Identification

In this Example, aptamers conjugated to microspheres are used to assist in determining the target of two aptamers identified by library screening methods as described above. The general approach is shown in FIG. 14. The approach is used to verify the targets of CAR029, an aptamer identified by library screening to recognize EpCAM, and CAR024, an aptamer identified by library screening to recognize an unknown target on the surface of VCAP microvesicles. See decription above for both CAR029 and CAR024. In this approach, the sequences of CAR029 and CAR024 are randomly rearranged before linkage to the microspheres. The microspheres are used as controls to bind to targets that are similar but not identical to the intended target molecule.

Exemplary aptamer controls used in this study are shown in Table 19. In Table 19, the sequences are shown 5' to 3' from left to right. Each sequence is derived from random rearrangement of CAR029 or CAR024 as indicated in the aptamer ID in the table. It is understood that the nucleotide sequences that are disclosed in Table 19 can also be modified to the extent that resulting modifications result in an aptamer having about 50, 55, 60, 65, 70, 75, 80, 85, 90, 95, 96, 97, 98, and 99 percent homology to the disclosed sequence and retain the desired functionality.

TABLE 19

Negative control aptamer sequences

| ID | SEQ ID NO. | Sequence 5' -> 3' |
|---|---|---|
| CAR029-Neg1 | 230928 | Biotin-ACTAAGCCAC CGTGTCCACC TTCACTCCGT TATTCCTGTG CTGCGTCACT CTGGAT |
| CAR029-Neg2 | 230929 | Biotin-TGCTGCGTCA CTCTGGATCC TTCACTCCGT TATTCCTGAC TAAGCCACCG TGTCCA |
| CAR024-Neg1 | 230930 | Biotin-ACTAAGCCAC CGTGTCCACT TTACTTACTC CTTTGTTTTG CTGCGTCACT CTGGAT |
| CAR024-Neg2 | 230931 | Biotin-TGCTGCGTCA CTCTGGATCT TTACTTACTC CTTTGTTTAC TAAGCCACCG TGTCCA |

The protocol used is as follows:

1) The candidate aptamers (here, CAR029 and CAR024) and control aptamers (here, CAR029-Neg1, CAR029-Neg2, CAR024-Neg1, CAR024-Neg2) are synthesized with modifications to allow capture (here, the aptamers are biotinylated) and crosslinking (here, using the Sulfo-SBED Biotin Label Transfer Reagent and Kit, Catalog Number 33073 from Thermo Fisher Scientific Inc., Rockford, Ill., to allow photocrosslinking).

2) Each of the aptamers is individually mixed with microvesicles having the target of interest (here, VCAP microvesicles).

3) After incubation to allow the aptamers to bind target, ultraviolet light is applied to the mixtures to trigger crosslinking of the aptamers with the microvesicle targets.

4) The microvesicles are lysed, thereby releasing the crosslinked aptamer-target complex into solution.

5) The crosslinked aptamer-target complexes are captured from solution using a streptavidin coated substrate.

6) The crosslinked aptamer-target complexes for each aptamer are run individually on SDS-PAGE gel electrophoresis. The captured protein targets are visualized with Coomasie Blue staining.

7) The crosslinking and binding steps may be promiscuous so that multiple bands including the intended target but also random proteins will appear on each of the gels. The intended target will be found in a band that appears on the gel with the candidate aptamer (here, CAR029 and CAR024) but not the related negative control aptamers (here, CAR029-Neg1, CAR029-Neg2; or CAR024-Neg1, CAR024-Neg2; respectively). The bands corresponding to the target are excised from the gel.

8) Mass spectrometry (MS) is used to identify the aptamer target from the excised bands.

Example 15: Anti-PSMA Aptamers

In this Example, an aptamer library is screened for aptamers to prostate specific membrane antigen (PSMA/FOLH1/NAALADase I) protein identified using 6 rounds of positive selection as in the Examples above. After selection for a pool of PSMA binding aptamers as described above, the aptamer library was sequenced using the Ion Torrent standard protocol (Life Technologies, Carlsbad, Calif.). Lead candidates were selected for the properties such as the following: common occurrence in screened library, affinity to the target, specificity to the target, defined molecular structure, presence of favorite conformation, stability of such conformation, no or small aggregation rate at working concentrations, straight forward and reproducible synthesis and purification.

A detailed experimental protocol is presented in Example 17 below. An overview of screening parameters and protocol included the following:

1. A "6 aptamer" ssDNA library generated from forward strand synthesized DNA library by AS PCR were used. The 6 aptamer library comprised variable sequences of 10n, 20n, 25n, 30n, 35n and 40n with leader and tail sequences shown in Table 20.

2. PSMA histag conjugated onto Dynabeads.

3. Multiple rounds of positive selection were performed by mix of the PSMA-conjugated beads with diluted aptamer library in F127/PEG4000 at about 2e12 copies/selection.

4. After each round, the re-suspended beads were added directly into the PCR reaction for amplification, no elution involved.

5. After the PCR amplification, the PCR were then digested with lambda nuclease for 2 hrs and the ssDNA were purified by zymo ssDNA purification kit.

6. Total 9 rounds of selection performed. For 35n and 40n library only 6 rounds were performed since the libraries did not perform.

7. Round 6 and Round 9 selection recovery were used in PCR cloning and 30 clones from Round 6 and Round 9 each library were picked and plasmids were amplified and purified.

8. For Round 6, 180 clones were used in the initial screening. For Round 9 there are total 120 clones were used in the initial screening against target.

9. Individual ssDNA clones were amplified in mini-scale and tested in the initial screening against target protein (Histag PSMA protein) as well as non-target proteins BSA and mouse Ig. Signal/noise ratio were calculated.

10. According to the screening above, individual clones were picked and ssDNA were amplified in a midi scale, and further titrated in the ELISA format against target.

11. Sanger sequencing was performed for final clones and the sequencing data was analyzed.

Most reproducible results were observed in the 30n aptamer library. Representative sequences obtained from these procedures are shown in Table 20. In Table 20, the sequences are shown 5' to 3' from left to right, wherein each complete sequence consists of the indicated 5' leader sequence followed by the indicated Variable Sequence followed by the indicated 3' tail sequence. Each sequence is derived from a library having a leader and tail with a variable sequence between. The table indicates whether the identified sequence comprises a biotin moiety on the 5' or 3' end. It is understood that the nucleotide sequences that are disclosed in Table 20 can also be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to PSMA antigen or functional fragments thereof.

TABLE 20

PSMA aptamer candidate sequences

| ID | SEQ ID NO. | 5'-Leader | Variable Sequence | Tail-3' |
|---|---|---|---|---|
| CAR050 | 230932 | Biotin-ACTAAGCCACCGTGTCCA | CCCCCCTCTGTCTCTTGTTTCTCTTTTCTA | TGCTGCGTCACTCTGGAT |
| CAR051 | 230933 | Biotin-ACTAAGCCACCGTGTCCA | GCCCTATTCCCTCGCTTTCTCCCCTTTTGT | TGCTGCGTCACTCTGGAT |
| CAR052 | 230934 | Biotin-ACTAAGCCACCGTGTCCA | CCCGCCTGATCCAAAGTACTGACTCTGTTA | TGCTGCGTCACTCTGGAT |
| CAR053 | 230935 | Biotin-ACTAAGCCACCGTGTCCA | CTTCTCTATCCAGATTGCCCCTTTATTCTT | TGCTGCGTCACTCTGGAT |

Figure 22:
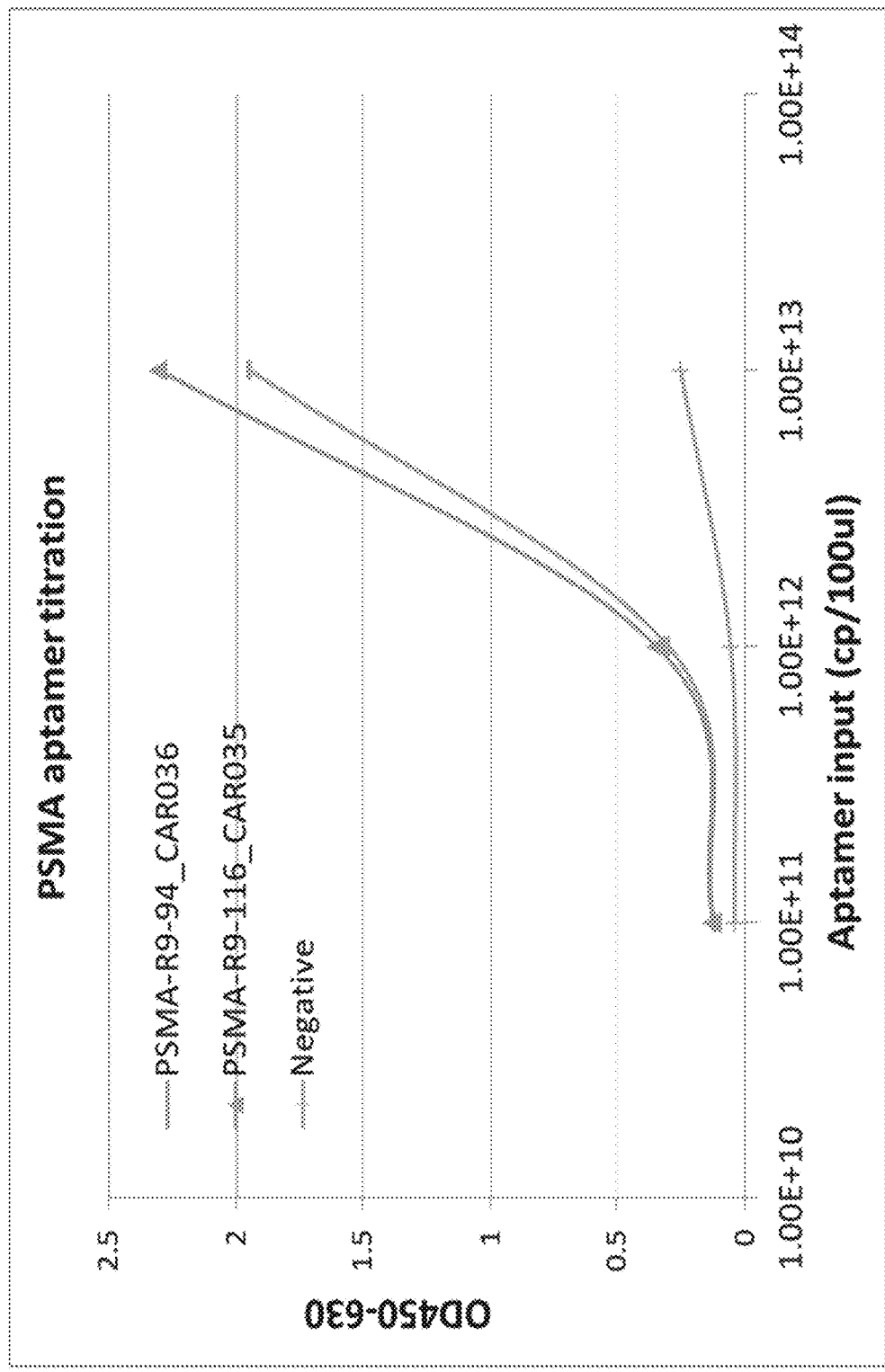
FIG. 22 illustrates binding affinity of anti-PSMA aptamer candidates CAR050 (SEQ ID NO. 230932) and CAR051 (SEQ ID NO. 230933) against PSMA protein as determined by ELISA assay against recombinant purified PSMA.

CAR050 and CAR051 were identified by cloning. The binding affinity of these two aptamers were tested against the PSMA/FOLH1/NAALADase I recombinant protein by ELISA. See FIG. 22. CAR052 and CAR053 were identified by sequencing using the Ion Torrent system after nine rounds of selection. CAR052 was the most common sequence in the torrent with 5.91% of the total read counts. CAR053, the second most common sequence, accounted for 3.34% of the total read counts.

Example 16: Competitive Isolation of Aptamers

As described herein, aptamers can be identified against a target of interest. In this Example, a competitive binding scheme is used to identify aptamers against a target of interest.

Figure 3:
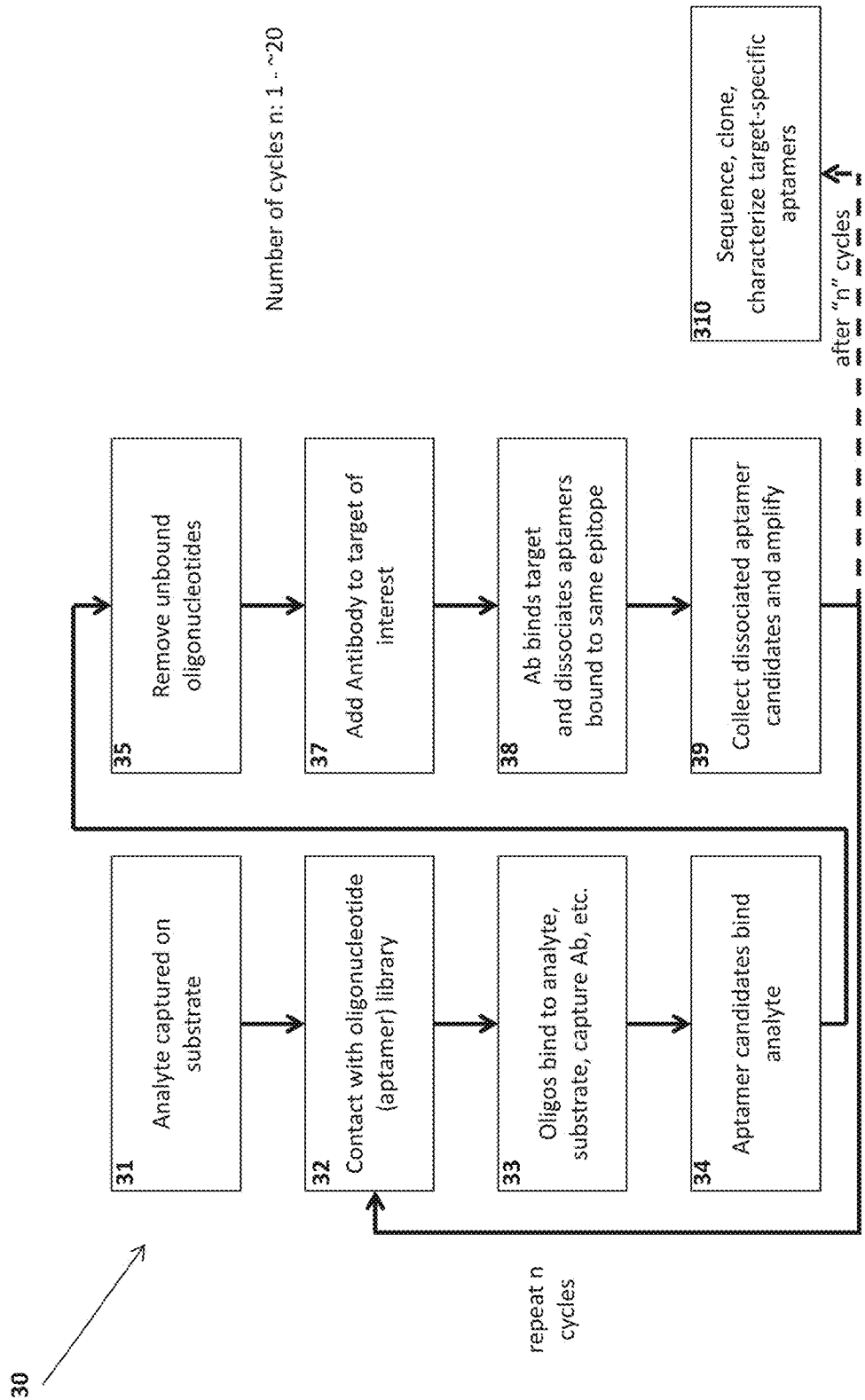
FIG. 3 presents a schematic for identifying aptamers against a target of interest.

The aptamer identification method 30 is outlined in FIG. 3. An analyte of interest, e.g., a biological entity such as a protein or microvesicle, is captured to a substrate 31. The substrate can be, e.g., a planar substrate or bead. The analyte can be captured covalently or non-covalently, e.g., the analyte can be captured using an antibody, aptamer, or streptavidin-biotin linkage. The captured analyte is contacted with a library of oligonucleotide aptamer candidates 32. The oligonucleotides bind to various components in the mixture, including the analyte, the substrate, the capture agent (e.g., antibody (Ab), aptamer, etc), reaction tube or well, biological debris, etc 33. Oligonucleotides that bind the analyte comprise aptamer candidates to the target of interest 34. Unbound oligonucleotides are removed via washing 35. After this step, the reaction mixture comprises the capture analyte bound by aptamer candidates. A ligand that recognizes a specific epitope, e.g., an antibody, is contacted with the reaction mixture 37. The ligand disassociates aptamer candidates bound to the same epitope as the ligand via competition for the epitope 38. The disassociated aptamer candidates are collected and amplified 39. Steps 32-39 are repeated a set number of times, n, e.g., 1-20 times, to further enrich the aptamer candidates with those that bind to the same epitope as the ligand. After the repeated cycles, the remaining aptamers are assessed by sequencing, and other characterizations 310 as described herein.

Control screening is performed in parallel with the above method. Any aptamer identified via the control screening are discarded. Controls analytes include without limitation bare substrate incubated with the analyte, bare substrate without the analyte, and the method performed with a control ligand, such as an antibody that does not bind a target of interest.

Example 17: Aptamer Selection Protocol

This Example provides a protocol for screening an aptamer library against a protein to identify candidate aptamer that bind the protein. The protocol can be used to identify aptamer candidates that bind microvesicles by substituting the target protein with target microvesicles. Adjustments in the protocol to account for microvesicles are noted where appropriate.

Experimental Design:
 1. Conjugate purified protein on the Dynabeads.
 2. Positive selection (SELEX) for desired number of round
 3. High throughput sequencing after select rounds (e.g., Next Generation using Ion Torrent)
 4. Cloning and validation of selected clones after desired rounds The detailed Aptamer Affinity Selection protocol as follows:
Reagents:
 1. Dynabeads® M-270 Carboxylic Acid ("beads") (Life Tech, 14305D)
 2. Water, Molecular Biology Reagent Grade (Sigma, W4502)
 3. Sulfo-NHS (Fisher Scientific, PI-24510)
 4. EDC (Fisher Scientific, PI-77149)
 5. MES Coupling Buffer: 0.05 M MES, pH 5.0 (pH may depend on target protein isoelectric point, pI)
    a. MES (2[N-Morpholino] ethanesulfonic acid) (Sigma, M2933)
    b. 5 N NaOH (Dilute to 1N NaOH) (Fisher, SS256-500)
 6. Bead Conjugation Wash Buffer and Storage Buffer: 0.01% PBS-Tween 20
    a. PBS, pH 7.5 (Sigma, P3813)
    b. TWEEN® 20 (Sigma, 9416)
 7. Target protein a. E.g., Histag-Epcam, C-ter Epcam, Histag-PSMA, tagless-FYN, tagless-AMACR, tagless-DBF4B
8. ELISA Wash Buffer: 0.05% PBS-Triton
9. Primary antibodies diluted in 1% PBS-B
10. Secondary antibodies diluted in 1% PBS-B
11. Aptamer library, 10n, 20n, 25n, 30n, 35n, 40n reverse library (lambda digested and purified). See Table 21, where n signifies a randomly selected nucleotide.

TABLE 21

Aptamer Library and PCR Primers

| Identity | Sequence (5' -> 3') | SEQ ID NO. |
|---|---|---|
| 50-mer aptamer library | 5'-actaagccaccgtgtcca-10n-tgctgcgtcactctggat | 231009 |
| 60-mer aptamer library | 5'-actaagccaccgtgtcca-20n-tgctgcgtcactctggat | 231010 |
| 65-mer aptamer library | 5'-actaagccaccgtgtcca-25n-tgctgcgtcactctggat | 231011 |
| 70-mer aptamer library | 5'-actaagccaccgtgtcca-30n-tgctgcgtcactctggat | 231012 |
| 75-mer aptamer library | 5'-actaagccaccgtgtcca-35n-tgctgcgtcactctggat | 231013 |
| 80-mer aptamer library | 5'-actaagccaccgtgtcca-40n-tgctgcgtcactctggat | 231014 |

12. 4% High Resolution E-Gel
13. Blocking and aptamer dilution buffer (0.5% F127 0.5% PEG4000 in PBS (Hyclone))
14. Washing buffer (PBS+1% BSA)
15. Phusion PCR reagents (New England Biolabs, Inc (NEB), Ipswich, Mass.)
16. AptamerPCR-F-SPhos/Aptamer-R-bio
17. Non-binding white 96 well plate. (see consumables)
18. Nanodrop.
19. Lambda exonuclease kit (NEB, 5 unit/ul).
20. Sanger sequencing reagents
21.

M13 Forward (-20) primer:
(SEQ ID NO. 231015)
5'-GTA AAA CGA CGG CCA GT

22.

M13 Reverse (-27) primer:
(SEQ ID NO. 231016)
5'-CAG GAA ACA GCT ATG AC

23. PEG4000, PEG8000
Consumables:
1. USA Scientific co-polymer polypropylene 1.5 ml microcentrifuge tubes (USA Scientific, 1415-2500)
2. Vi-cell vials (Beckman Coulter, 723908)
3. 96-well non-binding, flat bottom white plates (Corning® Costar® #3600)
4. 96-well non-binding, round bottom white plates (Corning® Costar® #3605)
5. 96-well medium-binding flat bottom clear plate (Corning® Costar® #9017)
Equipment:
1. Magnet: DynaMag™—Spin Magnet ("magnet") (Life Tech, 12320D)
2. Vi-Cell XR—Cell Viability Analyzer
3. Veriti
4. Nanodrop
5. Centrifuge (Eppendorf, 5415)
6. Plate Magnet: Magnetic Plate Separator ("plate magnet") (Luminex, CN-0269-01)
7. MixMate
8. BioTek Synergy 2 Plate Reader Procedure:
Step 1: Target Protein Conjugation
Purpose: To co-conjugate magnetic beads with target protein and MA-PEG to block unoccupied, activated sites and to avoid non-specific aptamer binding during selection
 1. Resuspend stock of beads by vortex for 2 minute.
 2. Pipette desired volume of beads into copolymer tube and bring to 100 ul with 25 mM MES, pH 5 (Coupling Buffer diluted 1:1 with water).
 3. Pellet the transferred beads by placing the tube on the magnet for 2 minutes and remove supernatant.
 4. Add 100 ul of 25 mM MES (Coupling buffer) and shake at 800 rpm for 10 minutes.
 5. Place on magnet for 1 minute and remove supernatant.
 6. Repeat for a total of 2-10 minute washes with MES.
 7. Immediately before use, dilute Sulfo-NHS with cold 25 mM MES to achieve a final concentration of 50 mg/ml (multiply mg×20 to achieve volume of water in ul).
 8. Immediately before use, dilute EDC with cold 25 mM MES by adding 200 ul per vial to a final concentration of 50 mg/ml.
 9. Add 200 ul of 50 mg/ml Sulfo-NHS and 200 ul of 50 mg/ml EDC to the beads and mix gently by vortex (800 rpm) for at least 30 minutes at RT, or 2 hours at 4° C.
 10. Pellet the activated beads by placement on the magnet for 1 minute and remove supernatant.
 11. Resuspend the beads in 400 ul of 25 mM MES Coupling Buffer, and mix gently by vortex (800 rpm).
 12. Pellet the beads by placement on the magnet for 1 minute and remove the supernatant.
 13. Repeat steps 11 and 12 for a total of two washes with 25 mM MES Coupling Buffer.
 14. Resuspend the activated and washed with the target protein and mix gently by vortex.
 15. Incubate for at least 30 minutes with mixing (by rotation) at room temperature.

16. Pellet the coupled beads by placement on the magnet for 1 minute and remove the supernatant.

17. Wash the beads four times with 0.01% PBS-Tween 20.

18. Pellet the supernatant and resuspend the coupled and washed beads in 200 ul of Storage Buffer and store in 500K beads/tube aliquots at −80 C.

19. Count the bead suspension using the Vi-Cell counter.
   a. Prepare a 1:100 dilution of beads:Storage Buffer by adding 14 ul of beads to 1386 ul of Storage Buffer in a Vi-Cell vial.
   b. Mix the diluted beads well by pipetting up and down several times.
   c. Transfer 700 ul of diluted beads to a new Vi-Cell vial.
   d. Read the duplicate vials for Total Cells.
   e. Determine the concentration of beads/ul by multiplying the Total Cell Count by the Dilution Factor in step 19a (i.e., 100).
   f. Determine the total yield of beads following conjugation by multiplying the concentration by the resuspension volume in step 18 (i.e., 200 ul).

Step 2a: Assess Bead Conjugation by ELISA

1. Add 200 ul of 1% PBS-B to wells of Costar, flat-bottom, non-binding plate.

2. Add 50,000 conjugated beads, seal plate, and incubate for 1 hr at room temperature (RT) with shaking at 800 rpm.

3. Place on plate magnet for 30 seconds with 800 rpm shaking. Remove supernatant.

4. Remove plate from plate magnet.

5. Wash 3× with 200 ul of 0.05% PBS-Triton, 3 min each with 800 rpm shaking.

6. Place on plate magnet for 30 seconds with 800 rpm shaking. Remove supernatant.

7. Add 100 ul of diluted primary antibody (AB) in 1% PBS-B to appropriate wells.

8. Seal plate well, Incubate 1 hr at 37 C with shaking, 800 rpm (on Jitterbug. Change Jitterbug to original speed following one hour inc.).

9. Spin plate to collect condensation.

10. Place on plate magnet for 3 min, remove primary AB and buffer.

11. Remove plate from plate magnet.

12. Wash 3× with 200 ul of 0.05% PBS-Triton, 3 min each with 800 rpm shaking at RT.

13. Place on plate magnet for 30 seconds with 800 rpm shaking. Remove supernatant.

14. Add 100 ul of diluted secondary AB in 1% PBS-B to appropriate wells.

15. Seal plate well, Incubate TIME—up to one hour—at RT with shaking, 800 rpm. NOTE: protect from light.

16. Place on plate magnet for 3 min, remove secondary AB and buffer.

17. Remove plate from plate magnet.

18. Wash 3× with 200 ul of 0.05% PBS-Triton, 3 min each with 800 rpm shaking at RT.

19. Place on plate magnet for 30 seconds with 800 rpm shaking. Remove supernatant.

20. Add 100 ul of substrate (TMB), pipet mix, seal and incubate TIME—up to 30 min—with 800 rpm shaking at RT. NOTE: protect from light.

21. Add 100 ul stop solution (2N sulfuric acid), seal and incubate 1 min with 800 rpm shaking at RT.

22. Place plate on plate magnet for 3 min, then transfer supernatant to new clear plate medium-binding plate and read at 450-630 nm using micro plate reader.

Step 3: Bead Based Aptamer Screening and Selection

Purpose: affinity maturation

Use synthetic reverse aptamer library directly (input will be $10^{13}$ to $10^{15}$ if necessary)

1. Dilute the beads in 0.5% F127/PEG4000 PBS (no $MgCl_2$) buffer to 100,000 beads/50 ul (use 100,000 beads for the first round and use lower as desired amount of beads afterward for more stringency), vortex at 800 rpm for 1 hr.

2. Aliquot 50 ul with 100,000 beads into each well on the non-binding flat bottom white plate.

3. In a separate copolymer tube (USA Scientific), dilute aptamer library in appropriate 0.5% F127/PEG4000 PBS with 2 mM $MgCl_2$ to achieve proper number of aptamer copies in a total volume of 50 ul per well (input aptamer amount could be up to $10^414$ for beads format)

4. Add 50 ul of diluted aptamer library to each 50 ul bead+buffer sample of the binding plate and incubate at RT with vortexing at 800 rpm for 30 min.

5. Place the plate with beads on the plate magnet for 2 min with 800 rpm shaking (the beads will concentrate in the center of the well).

6. Completely remove the buffer; leave plate on the plate magnet and tilt plate to collect liquid in corner without disturbing beads.

7. Remove plate from plate magnet and wash the beads with 200 ul of wash buffer (Using aptamer incubation buffer for the first 3 washers, then the general washing buffer is PBS-B, may increase salt concentration up to 500 mM NaCl as needed in later rounds) and vortex at 700 rpm for 1 min.

8. Place plate on plate magnet for 2 min with 700 rpm shaking. Repeat washes 10 times, a minute per wash with blocking buffer for the first 3 time, then use PBS-B (or PBS-B with increased salt buffer) for the rest.

9. After the last wash, place the plate on the plate magnet for 3 min with 700 rpm shaking, and then completely remove the buffer.

10. Re-suspend the bead with 52 ul of DNase free water, mix well by pipetting.

11. Transfer re-suspended beads to a new 1.5 ml tube (for the first round, use all in the PCR reaction)

12. Prepare PCR reaction. Use 4 (5 for the first round) reactions for each sample. Use 10 ul of re-suspended beads in 1 PCR reaction, total 4 reactions for 1 sample (Save 10 ul for cloning).

13. Aptamer recovery PCR amplification: For all libraries, the PCR can be performed with the Phusion polymerase: with PEG8000 additive, 98'C 30 sec, cycle at 98'C for 10 sec, 60'C for 30 sec and 68'C for 1 min. For 10n to 30n aptamer libraries, use as much as 30 PCR cycles. For 35n and 40n libraries, use below 25 cycles.

14. After the PCR amplification, add 10 ul of the lambda exonuclease directly to the PCR reaction, vortex and incubate at 37° C. for 2 hrs, terminated by heat up to 80'C for 10 min and then cool back to 4'C. Before terminating the digestion, run 2 ul on a 4% High Resolution E-Gel. If there is still dsDNA band, continue the digestion, if only ssDNA band shows, terminate the digestion.

15. Zymo ssDNA purification of the lambda digested product.

16. Nanodrop (only if Zymo-purified) to quantitate adjusted to estimated 2e12 copies for the next round. (If nanodrop reading is low, qPCR is necessary to calculate the concentration of the ssDNA)

17. Repeat the desired number of rounds of selection

Step 4: Cloning and ssDNA Production and Clone Plasmid Amplification

Purpose: to separate individual aptamer colonies and obtain purified plasmid

1. Prepared the Phusion cloning PCR reaction with forward and reverse aptamer library primers without 5' or 3' modification.
2. From the recovery aptamer (on beads above), add 5 ul of the re-suspended beads into the PCR reaction.
3. PCR cycles, for all libraries, should be less than 25 cycles.
4. Add 5 ul of E-gel buffer directly into the PCR reaction, mix and load the sample to the 4% E-gel, 2 well, 20 ul/well. Run until the yellow dye closed to the end of the gel.
5. Take an image of the gel on the image device.
6. Open the gel with the E-gel opener, do not break the gel itself. Put the gel on the top of the UV box inside the image machine.
7. Slice the gel based on the estimated edge of the band vertically, turn on the UV light and quickly cut the DNA band as fast as possible (use the 365 nm UV), put the gel with the DNA band in a 1.5 ml tube.
8. Estimated the gel size, (around 100 ul-200 ul), Purify the DNA from the gel by using the Zymo Gel extraction kit according to the instruction.
9. Final elute the DNA with 10 ul DNase/RNase free water
10. According to the TOPO blunt-end cloning kit from Invitrogen: mix 2 ul of the aptamer PCR eluted product, 1 ul of salt solution and 1 ul of the vector and 2 ul of water. Mix by pipetting. Incubate at RT for 15-30 min.
  1. Thaw the SOC medium and TOP 10 chemical competent cells on ice; add the TOPO ligation solution above directly to the cells, mix by pipetting. Incubate on ice for 30 min.
  2. Put the tube into 42'C water bath for exactly 30 sec then immediately cool it on ice for couple minutes.
  3. Add 250 ul of the SOC medium into the tube; horizontally shake the tube at 200 rpm at 37'C for 1 hr.
  4. Transfer 125 ul of the culture on at pre-warm LB agar plate with 100 ug/ml Ampicillin. Incubate at 37'C overnight.
  5. Make enough LB liquid medium and add 100 ug/ul Ampicillin stock to make 100 ug/ml LB medium. Transfer to the culture tube, 1 ml/tube.
  6. Use the sterilized 20 ul tip to pick individual colonies into respective culture tubes. Shake at 300 rpm overnight at 37'C.
  7. Plasmid extraction with 700 ul of the bacterial culture according to the Pure-Link plasmid mini pre protocol. Final elution to 75 ul TE (plasmid extraction could also use the Promega plasmid minipre Vacuume kit or the Genescript centrifuge plate kit, but should include a final maximal speed spin for 10 min to remove any trace chemicals).
  8. Use 2 ul in 1% Egel, take image for record.
  9. Estimate concentration of the plasmid prep using the Nanodrop. Adjust all the plasmid preparation to 2.5 ng/ul in water according to the calculation sheet (around 5e8 cp/ul).

Step 5: Mini-Pre of Clonal ssDNA for Initial Screening Test

Purpose: to prepare a limited quantity of single clone ssDNA and ready for the screening test.

1. For aptamer production (reverse strand), setup the PCR reaction with phosphorylated forward and biotinylated reverse aptamer library primers. Use 10 ul of the above 2.5 ng/ul plasmid solution in a 40 ul PCR reaction volume. PCR for 30 cycles.
2. After the PCR, add 10 ul of Lambda exonuclease directly to the PCR reaction, vortex and spin down, incubate at 37'C for 2 hrs followed by 80'C for 10 min then cool to 4'C. use 2 ul run on 4% E-gel to check if the digestion is complete. Once confirm the digestion is complete, stop the digestion and go on to the purification
3. Purify the ssDNA according to the zymo ssDNA purification kit instruction (for high throughput purpose, could use the Zymo Oligo purification kit in plate format, change the spin speed all to 5000 for all steps and maximal for the final dry spin for 10 min in the big centrifuge instead of 2000 in the manual). In both case, elute the ssDNA with 30 ul of DNase/RNase free water.
4. Estimate concentration of the the ssDNA using the Nanodrop.

Step 6: Clone Screening Test

Purpose: to test affinity (positive or negative based on criteria) individual aptamer clones (ssDNA) against target as well as control protein.

1. According to the initial screening test worksheet, the day before test, coat the target protein and control protein at desired concentration, 100 ul/well on High Binding ELISA plate, at RT for 3-5 hrs.
2. Block the plate with 250 ul of 0.5% F127/PEG4000 (no MgCl2) PBS overnight at 4'C.
3. According to the Nanodrop data, chose the volume for all sample that could reach the ssDNA level at about 10e11 to 10e12/well.
4. Dilute the ssDNA in 0.5% F127/PEG4000 PBS plus final concentration of 2 mM $MgCl_2$.
5. Remove the blocking solution from the plate; wash twice with PBS, 1 min for each wash. Tap on the paper towel to remove trace liquid.
6. Add 100 ul of ssDNA dilution (10e11-10e13/well. 100 ul), incubate at RT with shaking at 800 rpm for 4 hrs.
7. Wash the plate with PBS+1% BSA for 3 times, 1 min/wash at 400-800 rpm shaking. Remove the liquid and tap on the paper towel after each wash.
8. Dilute streptavidin-polyHRP at 1:1000 in PBS+1% BSA buffer, add 100 ul into each well. Incubate at RT for 1 hr with shaking
9. Wash the plate 3 times with PBS-1% BSA, tap on the paper towel to remove the trace liquid after each wash, 1 min/wash.
10. Pre-warm the Ultra ELISA substrate to RT, add 100 ul of the substrate into each well, and incubate in the dark with shaking for 30 min.
11. Stop the reaction by adding 100 ul of 2N $H_2SO_4$ and read OD450-630 by the microplate reader.
12. According to a defined criterion, (for example, OD above certain level in this standardized protocol or above the control protein), to make judgment of which clone is positive or negative.

Step 7: Mid-Scale Production of Aptamer ssDNA from Candidate Clone for Further Quantitative Evaluation Purpose: to prepare greater quantity of ssDNA from aptamer candidate clone for further confirmation of the affinity to target.

1. For aptamer production (reverse strand), setup the PCR reaction with phosphorylated forward and biotinylated reverse aptamer library primers. Use 5 ul of the above 2.5 ng/ul plasmid solution in a 40 ul PCR reaction volume, 12 reactions per sample. Run PCR amplification for 30 cycles.
2. After the PCR amplification, add 10 ul of Lambda exonuclease directly to the PCR reaction, vortex and spin down, incubate at 37° C. overnight for 2 hrs. Use 2 ul of the reaction to run on a 4% Egel to check the digestion as described above.

3. Purify the ssDNA according to the zymo ssDNA purification kit instruction (4 reactions through 1 zymo purification column). NOTE: This step uses the ssDNA purification kit, NOT the plate oligo purification kit used above.

4. Combine different elution from same sample, use Nanodrop to quantitate the ssDNA concentration.

5. Store the purified aptamer at −80° C.

Step 8: Validation Assay of Individual Aptamer Clones

Purpose: to further evaluate the selected clones in a quantitative manner.

1. For further validation test, both the target and the aptamer are titrated against each other. At least 1 non-target protein (at 1 coating concentration) is titrated against the aptamer in order to evaluate non-specific binding.

2. Coat ELISA plate wells with three different concentration of the target protein (e.g., 1 ug, 0.5 ug and 0.25 ug/ml, at 100 ul/well) as well as the non-target protein (generally 0.5 ug/ml and 100 ul/well) in PBS for 3-5 hrs. Block the plate overnight with 0.5% F127/0.5% PEG4000 (no $MgCl_2$) in PBS.

3. Dilute the aptamer over at least 4 orders of magnitude (e.g., from 10e13 to 10e10/well or 10e12 to 10e9/well depending on recovery) in the PBS with 0.5% F127/PEG4000. Add 100 ul of the aptamer dilution to the respective wells. Incubate the plate at RT at 800 rpm for 4 hrs. NOTE: If using microvesicles instead of purified protein to assess aptamer binding, incubate at 300 rpm instead of 800 rpm.

4. Wash the plate with 250 ul of PBS-1% BSA, tap on the paper towel after each wash to remove the trace liquid.

5. Dilute streptavidin-polyHRP at 1:1000 in PBS-1% BSA, add 100 ul of the solution to each well, incubate at RT with 800 rpm for 1 hr. NOTE: If using microvesicles instead of purified protein to assess aptamer binding, incubate at 300 rpm instead of 800 rpm.

6. Wash the plate 3 times with PBS-1% BSA, tap on the paper towel to remove the trace liquid.

7. Add 100 ul of UltraSubstrate (prewarm to RT at least 2 hrs before use) to each well, cover the top by the foil. Shake at 300-400 rpm for 30 min at RT. Add 100 ul of the 2N $H_2SO_4$ to stop the reaction.

8. Read OD450-630.

Step 9: Sanger Sequencing

Purpose: Obtain sequence information from the selected clones.

1. Sequencing primers: M13 Forward (−20) and M13 Reverse (−27)

2. According to the Sanger sequencing protocol, make the sequencing master mix and aliquot to 8 ul/well.

3. The mini-pre plasmid from selected clones will be used directly for the sequencing (the plasmid concentration should be at least 10 ng/ul).

4. Add 2 ul of the plasmid mini-pre sample to the respective well. Cycles as the BDT standard reaction.

5. Cleanseq the sample according to the established protocol.

6. Perform Sanger sequencing run.

7. On the FinchTV software, open the desired sequencing file (F first, if F file is not readable or quality is poor, use R file).

8. In the search bar, enter EcoRI (GAATTC) and click search.

9. The EcoRI site is 6 bases ahead of the starting of the aptamer primer sequencing if the aptamer PCR product successfully cloned into the vector. Click reverse the sequence display, from the last base on the EcoR1 site (C), the next 6 bases from the vector should be GCCCTT, the following sequence should match the either the aptamer forward pattern (ATCCAGA . . . ) or the reverse strand template (ACTAA . . . ).

10. Since the aptamer cloning direction is random, therefore, the starting of the aptamer sequence could be forward (starting as ATCCAGA . . . GCAGCA) or reverse (starting at ACTAA . . . GTCCA). When checking the sequence, identify the direction of the aptamer (forward direction or reverse).

11. Read base by base on the sequencing gram to verify the call is correct.

12. Record sequence in both forward and reverse direction.

Example 18: Aptamer Library Selection Protocol

This Example provides the protocol for SUL1 RNA library selection performed in the Example above. The protocol can be followed for other aptamer libraries and sample input as desired.

Preparation

The working space is cleaned with 80% EtOH before working.

Beads are MagPlex beads (Luminex Corp., Austin, Tex.). Other beads can be substituted as desired.

Buffers/Reagents to Prepare:

MilliQ water 100 mM $MgCl_2$

5× Transcription Buffer (200 mM Tris pH 7.9)

1×PBS

1×PBS with 3 mM $MgCl_2$

10×PBS

Selection buffer (1×PBS with 0.1% BSA and 3 mM $MgCl_2$)

Before starting with selection, remove the bead storage buffer, and wash beads with 1×PBS w/3 mM $MgCl_2$ 1 times (200 uL total in all 4 tubes). 200,000 beads per selection are used.

Binding 2'F SUL1 RNA Pool to Microvesicle Coated Magnetic Beads

Abbreviations: TK—Transcription; NTC—No template control.

Steps:

1. $1^{st}$ Round: Mix 1 nmol purified 2'F SUL1 RNA with 20 µl of resuspended beads (conjugated with microvesicle). 10 uL of 10×PBS+1% BSA, 3 µl 100 mM $MgCl_2$, and 47 uL $H_2O$. This gives a final concentration of 1×PBS, 0.1% BSA, 3 mM $MgCl_2$.

1.1 The addition of $MgCl_2$ in this step gives a concentration of 3 mM $MgCl_2$. This is the binding concentration for the entire process.

1.2 Following Rounds: Mix 20 µl of transcription product (15 mM $MgCl_2$ inside) with 20 µl of washed microvesicle coated beads, plus 9 uL 10×PBS with 1% BSA, 51 uL $H_2O$. No additional $MgCl_2$ is needed because the $MgCl_2$ in the diluted transcription product (TK) provides a final concentration of 3 mM $MgCl_2$.

2. Incubate for 30 min at 37° C., shake at 1000 rpm, and pipet mix every 10 minutes.
3. Wash the beads:
   3.1 One washing cycle comprises:
      3.1.1 Remove the beads from the magnet
      3.1.2 Resuspend beads in 100 µl 1×PBS+3 mM MgCl₂ off the magnet.
      3.1.3 Incubate sample for 30 seconds off of the magnet.
      3.1.4 Place the sample back onto the magnet, and wait until the beads are on the side.
      3.1.5 Remove and discard the supernatant.
      3.1.6 Resuspend in 100 µl 1×PBS+3 mM MgCl₂+0.1% BSA off of the magnet.
      3.1.7 Incubate sample for 3 minutes off of the magnet.
      3.1.8 Place the sample back onto the magnet, and wait until the beads are on the side.
      3.1.9 Remove and discard the supernatant
   3.2 1$^{st}$ Round: Place bead mixture on a magnet and remove the supernatant. Wash once with 100 µl 1×PBS+3 mM MgCl₂+0.1% BSA (by pipette mixing the beads), and discard buffer.
   3.3 Following Rounds: Increase the washing steps every second round by one more washing step up to 3 washing steps.
4. Add 55 µl MilliQ water to the bead sample.
5. Elute the RNA by incubating the bead sample for 5 min at 80° C.
   5.1 Check if there is 50 µl, if not spin the sample down to spin down the condensed water off the top.
   5.2 Transfer the supernatant to a new vial. Work quickly to avoid the strands rebinding the beads.
      5.2.1 Use 50 µl eluate for the following RT-PCR and store the rest at −20° C.

RT-PCR of Recovered Aptamer Candidates

Practice Guides

The rest of the RT-PCR sample and the TK-PCR sample is stored at −20° C.
RNA can be stored at 4° C. for ~1 h
RT-PCR product can be stored overnight at 4° C.
Proceed to the next selection cycle for optimal RNA quality immediately after transcription.
Avoid vortexing RNA
Mix on ice
Use 0.5 ml PCR tubes
Every RT-PCR should have a no-template control (NTC) with water instead of template
Do not freeze-thaw DTT more than one time
6. Prepare a Master Mix (see Table 21-A) before the first round, check it with 0.5 pmol RNA and store aliquots of 48 µl at −20° C. until usage.

TABLE 21-A

RT-PCR master mix

| Reagent | Volume (µl)/reaction | Final concentration |
| --- | --- | --- |
| 5× Colorless GoTaq Flexi Buffer Promega cat# M890A | 20 | 1× |
| 5 × first strand buffer (Invitrogen) lot# 1300427 | 4 | 0.2 × |
| 100 mM DTT | 2 | 2 mM |
| 100 µM SUL1 F primer | 1 | 1 µM |
| 100 µM SUL1 R primer | 1 | 1 µM |

TABLE 21-A-continued

RT-PCR master mix

| Reagent | Volume (µl)/reaction | Final concentration |
| --- | --- | --- |
| 100 mM MgCl₂ | 1.5 | 1.5 mM |
| 25 mM (each) dNTPs | 1.2 | 300 µM |
| MilliQ water | 17.3 | |
| Total | 48 | |

7. Add 50 µl MilliQ water as negative control (NTC) (pipette this first) or 50 µl selection eluate. Pipet mix.
8. Incubate at 65° C. for 5 min.
9. After cooling to 4° C., add:
   9.1 1 µl Superscript II Reverse Transcriptase (Invitrogen, cat#18064) (200 U/l)
   9.2 1 µl GoTaqFlexi DNA polymerase (5 units/l) Promega cat# M8305.

PCR-Program (SARTPCR)
a) 10 min 54° C.
   (This step is only for reverse transcriptase, should more rounds be needed, do not repeat step A.)
b) 1 min 95° C.
c) 1 min 60° C.
d) 1 min 72° C.

10. Cycle steps b-d for
    10.1 1$^{st}$ round b-d 4 cycles. Run 5 µL PCR products on a 4% agarose gel.
       10.1.1 Subsequent rounds: The amount of RNA is decreased after the first round, leading to an increase in required PCR-cycles. To determine the number of cycles needed each time, check the band intensity from the agarose gel from the previous round of selection. Use that number of cycles to start the next round of RT-PCR. Note: Always check results on an agarose gel.
          10.1.1.1 Agarose gel results: product band should be seen at the target length. The band intensity should be about the same as the 50 bp ladder band (if not a little less intense). If the band is not intense enough (barely visible), cycle an appropriate amount more and re-check on an agarose gel.

Transcription

All mixing performed on ice. Prepare transcription Master Mix (Table 22) and store aliquots of 85.7 µl at −20° C. until use.

11. Verify pH of stock 200 mM Tris pH 7.9 before use. A change in pH over time may cause problems with the transcription.

TABLE 22

Transcription (TK) Master Mix for SUL1 library

| Reagent | Volume (µl) for one reaction | Volume (µl) for 20 reactions | Final concentration |
| --- | --- | --- | --- |
| 5× Transcription buffer (200 mMTris, pH 7.9) | 20 | 400 | 1× |
| 100 mM DTT | 5 | 100 | 5 mM |
| 100 mM ATP | 1 | 20 | 1 mM |
| 100 mM GTP | 1 | 20 | 1 mM |
| 100 mM 2'F-dUTP | 3 | 60 | 3 mM |

TABLE 22-continued

Transcription (TK) Master Mix for SUL1 library

| Reagent | Volume (µl) for one reaction | Volume (µl) for 20 reactions | Final concentration |
|---|---|---|---|
| 100 mM 2'F-dCTP | 3 | 60 | 3 mM |
| 100 mM MgCl$_2$ | 15 | 300 | 15 mM |
| MilliQ water | 37 | 740 | |
| Total volume | 85 | 1700 µl | |

12. Add 10 µl RT-PCR product to the mastermix.
13. Add 1 µl RNasin (40 units/µl)
    13.1 Promega Recombinant RNasin Ribonuclease Inhibitor cat# N2515/N2511
14. Add 4 µl T7 Y639F mutant polymerase (25 U/µl use: 100 U total per reaction)
15. Perform the reaction for 30 min at 37° C.
16. Use the transcription-product directly for the next selection round. If the next step is not feasible, freeze transcription product at −20 C.

Subsequent Rounds

Repeat the bead incubation, the RT-PCR and transcription as often as needed. Try to have similar band intensity of the RT-PCR product for the sample in all rounds as noted above.

Binding Assay

A binding assay is performed after desired rounds of selection to determine to assess non-specific binding of cancer selected aptamers to control beads (conjugated to supernatant from plasma ultracentrifugation, see above) and likewise for non-cancer control samples. Binding assays can also be performed to assess binding of selected aptamers against the intended target microvesicles.

Cherenkov protocol: Performed using $^{32}$P radioactively labeled aptamer library.

Final concentration of selection buffer: 1×PBS+3 mM MgCl$_2$+0.01% BSA pH 7.4

Wash buffer: 1×PBS+3 mM MgCl$_2$ pH 7.4
1. Remove microvesicle samples from −80° C. freezer and thaw.
2. Place beads on magnet (200,000 per sample experiment), remove bead storage buffer.
3. Wash 1×200 µL for 1 minute each with 1×PBS, 3 mM MgCl$_2$ buffer. Pool beads to make 200,000 in one tube.
4. Resuspend beads in 70 µL of the selection buffer. (10 µl of 10×PBS, 1% BSA+3 µL 100 mM MgCl$_2$+57 µL H$_2$O per sample).
5. Add 30 µL radioactively labeled RNA aptamer library to their respective sample.
6. Incubate shaking at 1000 rpm at 37° C. for 30 min.
7. Place samples on a magnet.
8. Remove and save supernatant.
9. Wash beads with 200 µL wash buffer 1×PBS 3 mM MgCl$_2$ pH 7.4, incubating off the magnet for 3 minute.
10. Place samples on the magnet, remove and save wash solution.
11. Repeat steps 9, 10.
12. Add 100 L water to the sample, pipette mix.
13. Heat at 80° C. for 5 minutes.
14. Place samples on a magnet, remove supernatant, and save.
15. Resuspend beads in 100 L water.
16. Measure radioactivity of every fraction using scintillation counter.
17. Analyze amount of background binding present.

Negative Selection

As desired, a negative selection step is added prior to incubating the aptamer library with the beads conjugated to the target microvesicles (i.e., procedure "Binding 2'F SUL1 RNA pool to microvesicle coated magnetic beads" above). The negative selection can be performed using beads conjugated to the supernatant or the input samples (e.g., plasma) after microvesicles are filtered or sedimented from the sample (referred to as "no microvesicle coated beads," "microvesicle depleted samples," or similar). The steps are:

1) Start with aptamer library product from the desired round after transcription as described above. Wash the beads before start: remove storage buffer, wash beads with 200 µL wash buffer, then replace buffer as stated below:

2) Negative selection step: Add and pipet mix 20 µl of transcription product (15 mM MgCl$_2$) with freshly washed 'no microvesicle' coated beads with 10 µL 10×PBS with 1% BSA, 70 µL H$_2$O. No additional MgCl$_2$ is needed because the MgCl$_2$ in the diluted transcription product (TK) provides a final concentration of 3 mM MgCl$_2$.

3) Incubate for 30 min at 37° C., shake at 1000 rpm.

4) Remove supernatant and add it to the positive selection beads (directly), which are washed microvesicle coated beads.

Continue with positive selection incubation. See Binding 2'F SUL1 RNA pool to microvesicle coated magnetic beads above, starting at step 2. Additional steps through transcription are as detailed above.

Example 19: Aptamers to Breast Cancer (BrCa) Derived Microvesicles

In this Example, an aptamer library is screened to identify aptamers that distinguish between microvesicles circulating in the blood of breast cancer patients and microvesicles circulating in the blood of healthy, control individuals (i.e., without breast cancer).

Microvesicles were isolated from plasma of a pool of 60 breast cancer patients (BrCa+). Microvesicles were also isolated from pool of 60 non-cancer samples (BrCa—). Microvesicles were isolated from the plasma using ultracentrifugation (120,000×g). Microvesicles were in the pellet from the ultracentrifugation. The supernatant from the ultracentrifugation was saved to use as a control. The microvesicles from both sample types were conjugated to MagPlex beads (Luminex Corp, Austin Tex.). Optionally, the isolated microvesicles are incubated with anti-HSA/IgG/Fibrinogen beads to remove these highly abundant blood proteins. However, the conjugation step can be optimized to favor conjugation of the microvesicles such that removal of highly abundant proteins is not strictly necessary.

The aptamer library used consisted of a 2'F SUL1 RNA aptamer library. The sequence is 5'-GGGAGGAC-GAUGCGG-N40-CAGACGACUCGCUGAGGAUC-CGAGA-3' (SEQ ID NO. 231017). The aptamer library consists of three sections: Forward primer—15 nucleotides, variable region—40 nucleotides; reverse primer—25 nucleotides. All pyrimidines (C and U) were 2'Fluoro modified.

The aptamer library was incubated with either the cancer or control microvesicle-conjugated beads. Thirteen rounds of positive selection for aptamers that bind the microvesicles were performed in parallel for both types of samples. See Example 18 above for detailed protocol of the positive selection steps. Negative selection was not performed.

The aptamers that were retained from the above positive selection were sequenced using Next Generation sequencing technology consisting of Ion Torrent NGS (Life Technologies, Inc., Carlsbad, Calif.). The MiSeq system may be used also (Illumina, Inc., San Diego, Calif.). The sequences are compared to identify aptamers that are found in the cancer samples and not the control samples, and vice versa. Such aptamers provide candidates that can be used to distinguish between BrCa and non-BrCa samples.

A number of representative sequences obtained from these procedures are shown in Table 23. The sequences in the table were identified in the aptamer pools from selection against BrCa microvesicles but were not in the aptamer pools selected against non-cancer samples. In Table 23, the sequences are shown 5' to 3' from left to right, wherein each complete sequence consists of the indicated 5' leader sequence followed by the indicated Variable Sequence followed by the indicated 3' tail sequence. Each sequence is derived from a library having a leader and tail (see description above) with a variable sequence between. It is understood that the nucleotide sequences that are disclosed in Table 23 can also be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to microvesicle antigens or functional fragments thereof.

DNA sequence directly follows its corresponding RNA sequence. For example SEQ ID NO. 231019 is the DNA sequence corresponding to RNA sequence SEQ ID NO. 231018, etc. The DNA forms of the aptamers are synthesized for further characterization as well.

The aptamers above were identified using positive selection for aptamers which recognize BrCa and non-BrCa microvesicles conjugated to microspheres.

Example 20: Additional Aptamers to Breast Cancer (BrCa) Derived Microvesicles

In this Example, an aptamer library is screened to identify aptamers that distinguish between microvesicles circulating in the blood of breast cancer patients and microvesicles circulating in the blood of healthy, control individuals (i.e., without breast cancer). The procedure uses the same samples and aptamer library as in Examples 17-19 above. Negative selection is performed before each positive selection starting after the third round of positive selection.

Negative selection serves to remove aptamers that bind soluble/abundant/non-informative and common proteins for cancer and non-cancer proteins. Negative selection include performing negative selection on the aptamer candidates selected against cancer-derived microvesicles as follows: (i) using microbeads conjugated to the supernatant from the cancer-derived plasma ultracentrifugation step (which should not contain microvesicles); (ii) using microbeads conjugated to the supernatant from the cancer-negative

TABLE 23

BrCa microvesicle aptamer candidate sequences

| ID | SEQ ID NO. | 5'-Leader | Variable Sequence | Tail-3' |
|---|---|---|---|---|
| BRCA_APT1_RNA | 231018 | GGGAGGACGAUGCGG | CGCGUCUUCCCCGCA UUGCCGCAAUUGCCA UACAUUAAUA | CAGACGACUCGCUGA GGAUCCGAGA |
| BRCA_APT2_RNA | 231020 | GGGAGGACGAUGCGG | GUCCGGAACGCCUCG AUCCUCGCAUAAUAU GAUACGUCUG | CAGACGACUCGCUGA GGAUCCGAGA |
| BRCA_APT3_RNA | 231022 | GGGAGGACGAUGCGG | GUCCAUGGUACGCCU CGAUUCCGCCCAUAC AUGCAUGUAA | CAGACGACUCGCUGA GGAUCCGAGA |
| BRCA_APT4_RNA | 231024 | GGGAGGACGAUGCGG | CACUAUCCGUUUGUC CGUCCUCUUGUGGUA UUGCGCAUGC | CAGACGACUCGCUGA GGAUCCGAGA |
| BRCA_APT5_RNA | 231026 | GGGAGGACGAUGCGG | UCUUCCAUCUGGUCG CGAUACAGAAUACG AUUAACAUAAA | CAGACGACUCGCUGA GGAUCCGAGA |
| BRCA_APT6_RNA | 231028 | GGGAGGACGAUGCGG | GAUCACGCUGCCCUU UGUUUAAGGCCUUU AUACAAACGCA | CAGACGACUCGCUGA GGAUCCGAGA |
| BRCA_APT7_RNA | 231030 | GGGAGGACGAUGCGG | UAUUCGCCAGUCACA UCAACUAUGAUGAC GCUUGACUGGA | CAGACGACUCGCUGA GGAUCCGAGA |

Each sequence in Table 23 is synthesized in two variants for further investigation: 5' biotinylated and 3' biotinylated. This provides aptamer variants that can be captured at the 5' end or the 3' end as desired. The aptamers are further synthesized with each pyrimidine (C and U) 2'Fluoro modified.

The DNA sequence corresponding to each RNA sequence in Table 23 is provided in the sequence listing, where the plasma ultracentrifugation step (which should not contain microvesicles); (iii) using microbeads conjugated to cancer-negative microvesicles. Negative selection can also be performed on the aptamer candidates selected against cancer-negative microvesicles as follows: (i) using microbeads conjugated to the supernatant from the cancer-positive plasma ultracentrifugation step (which should not contain microvesicles); (ii) using microbeads conjugated to the supernatant from the cancer-negative plasma ultracentrifugation step (which should not contain microvesicles); (iii) using microbeads conjugated to cancer-positive microvesicles. Negative selection rounds are performed between rounds of positive selection as described herein.

Microvesicles are isolated from plasma of a pool of 60 cancer-positive patients and from a pool of 60 non-cancer samples using ultracentrifugation (120,000×g). Microvesicles are found in the pellet from the ultracentrifugation. The supernatant from the ultracentrifugation is saved to use as a control. The microvesicles from both sample types are conjugated to MagPlex beads (Luminex Corp, Austin Tex.).

The aptamer library used consists of a 2'F SUL1 RNA aptamer library. The sequence is 5'-GGGAGGAC-GAUGCGG-N40-CAGACGACUCGCUGAGGAUC-CGAGA-3' (SEQ ID NO. 231017), wherein the N40 signifies 40 random nucleotides. The aptamer library consists of three sections: Forward primer—15 nucleotides, variable region—40 nucleotides; reverse primer—25 nucleotides. All pyrimidines (C and U) were 2'Fluoro modified.

The aptamer library is incubated with either the cancer or control microvesicle-conjugated beads. Nine rounds of positive selection for aptamers that bind the microvesicles are performed in parallel for both types of samples. Negative selection is performed against beads conjugated to the input plasma supernatant after ultracentrifugation before positive selection in rounds 4-9. See Examples above for detailed protocol of the positive selection and negative selection steps.

The aptamers that are retained from the above positive selection are sequenced using Next Generation sequencing technology consisting of Ion Torrent NGS (Life Technologies, Inc., Carlsbad, Calif.). Any appropriate high-throughput sequencing platform such as the MiSeq system may be used for this step (Illumina, Inc., San Diego, Calif.). The sequences are compared to identify aptamers that are found in the cancer samples and not the control samples, and vice versa. Such aptamers provide candidates that can be used to distinguish between cancer and non-cancer samples.

The sequencing data is analyzed according to the following procedure:

Step 1: Sequences are ranked according to frequencies in entire aptamer pool recovered in round 9 after negative selection against beads conjugated to microvesicle-depleted cancer plasma followed by positive selection against beads conjugated to cancer microvesicles.

Step 2: Fold changes are calculated between sample noted in Step 1 and: (i) same sample after additional negative selection against microvesicle depleted cancer plasma; (ii) same sample after additional negative selection against non-cancer microvesicles; (iii) same sample after additional negative selection against microvesicles depleted non-cancer plasma.

Step 3: Sequences are ranked based on fold changes calculated in Step 2 to identify sequences which are abundant or deficient in aptamer pool selected for breast cancer derived microvesicles.

Step 4: Possible mutant sequences (e.g., due to PCR or other errors) are removed based on results of consolidation analysis.

Step 5: Sequences are identified with fold changes greater than 3 and minimum frequency 50 in all three variants (i, ii and iii in step 2).

The same selection schemes as in steps 1-5 are performed for aptamers selected against beads conjugated to non-cancer microvesicles.

The resulting sequences are synthesized in two variants for further investigation: 5' biotinylated and 3' biotinylated. This provides aptamer variants that can be captured at the 5' end or the 3' end as desired. The aptamers are further synthesized with each pyrimidine (C and U) 2'Fluoro modified. The aptamers may also be synthesized as the DNA sequence corresponding to each RNA sequence. The aptamer libraries can also be filtered based on predicted secondary sequence, free energy, and other parameters as described herein. Identified sequences are commonly overrepresented in cancer positive pools as compared to controls. However, identified sequences overrepresented in the non-cancer pools are also observed.

A number of representative sequences obtained from these procedures are shown in Table 24. The sequences in the table were identified in the aptamer pools from selection against microvesicles obtained from plasma of breast cancer patients but were not in the aptamer pools selected against non-cancer plasma samples. In Table 24, the sequences are shown 5' to 3' from left to right, wherein each complete sequence consists of the indicated 5' leader sequence followed by the indicated Variable Sequence followed by the indicated 3' tail sequence. Each sequence is derived from a library having a leader and tail (see description above) with a variable sequence between. It is understood that the nucleotide sequences that are disclosed in Table 24 can also be modified to the extent that resulting modifications result in an aptamer having about 50, 55, 60, 65, 70, 75, 80, 85, 90, 95, 96, 97, 98, and 99 percent homology to the disclosed sequence and retain the functionality of binding to microvesicle antigens or functional fragments thereof.

TABLE 24

BrCa microvesicle aptamer candidate sequences

| ID | SEQ ID NO. | 5'-Leader | Variable Sequence | Tail-3' |
|---|---|---|---|---|
| BCE8 | 231032 | GGGAGGACGAUGCGG | UACCGCCUCAUCAUC GGACACGACGUGUA UCAGUUGGCUG | CAGACGACUCGCUGA GGAUCCGAGA |
| BCE9 | 231033 | GGGAGGACGAUGCGG | GUUCUCGCCUCUGUC CUCAUGGUUCGAACC GGUAUGCAUG | CAGACGACUCGCUGA GGAUCCGAGA |
| BCE10 | 231034 | GGGAGGACGAUGCGG | GCGGUUUCUUCUCCU GACUACAUGAGAUU AAUAAACGCGC | CAGACGACUCGCUGA GGAUCCGAGA |
| BCE11 | 231035 | GGGAGGACGAUGCGG | CCGCCUCGAACACUG | CAGACGACUCGCUGA |

TABLE 24-continued

BrCa microvesicle aptamer candidate sequences

| ID | SEQ ID NO. | 5'-Leader | Variable Sequence | Tail-3' |
|---|---|---|---|---|
| | | | ACGUCGUGGAACCUUCGAUUGCUAG | GGAUCCGAGA |
| BCE12 | 231036 | GGGAGGACGAUGCGG | AAUCACAGUAAUUCUGCCCCUCUGAUGAAACCGGUUACUU | CAGACGACUCGCUGAGGAUCCGAGA |
| BCE13 | 231037 | GGGAGGACGAUGCGG | CUUAGUGAUUUCGCCGCCCCUCUGUUUAGUGGCCAUUGGA | CAGACGACUCGCUGAGGAUCCGAGA |
| BCE14 | 231038 | GGGAGGACGAUGCGG | ACACUAUUCCGGUAAGUCAUCGUUUAACCGUUUGUUGCAA | CAGACGACUCGCUGAGGAUCCGAGA |
| BCE15 | 231039 | GGGAGGACGAUGCGG | UGCGCAACGCCUUGAUUCACUCCUACAGUGUGUCUAUAGA | CAGACGACUCGCUGAGGAUCCGAGA |
| BCE16 | 231040 | GGGAGGACGAUGCGG | AAUGUUAAGCUUACAUACGCCUGGGUCACUCUUUGUUCUG | CAGACGACUCGCUGAGGAUCCGAGA |
| BCE17 | 231041 | GGGAGGACGAUGCGG | GUAAAUAUUCACGUUGAAUCGCCUUGCUCCUCUUAGUCUG | CAGACGACUCGCUGAGGAUCCGAGA |
| BCE18 | 231042 | GGGAGGACGAUGCGG | CCGCCUCGGAUCGUUCCCAAUGGUGGUACCCCUAUUAAUG | CAGACGACUCGCUGAGGAUCCGAGA |
| BCE19 | 231043 | GGGAGGACGAUGCGG | UGUAGAUCGUUCUUAUCCGCCUCGGUCUUCCCCAGGUUAA | CAGACGACUCGCUGAGGAUCCGAGA |
| BCE20 | 231044 | GGGAGGACGAUGCGG | AUCGUCGGGCCCCUUUUAUGAAACUUACAUGAAAGCGCAC | CAGACGACUCGCUGAGGAUCCGAGA |
| BCE21 | 231045 | GGGAGGACGAUGCGG | UAAGAGUGCACAGUACUGCCUCGAUCCUCCAUGGCUUAAG | CAGACGACUCGCUGAGGAUCCGAGA |
| BCE22 | 231046 | GGGAGGACGAUGCGG | GAAUUAGUACUGACGGCCGCCUUGAUCCUCCGUUAGUCUG | CAGACGACUCGCUGAGGAUCCGAGA |
| BCE23 | 231047 | GGGAGGACGAUGCGG | GCCCGCCUCCGAAGCCCUCCUAAGUGCACUUUAAACCGCG | CAGACGACUCGCUGAGGAUCCGAGA |
| BCE24 | 231048 | GGGAGGACGAUGCGG | CCGCCUGGGAUCACUCUCUACGCGUAUAAAUGCUCUGUCA | CAGACGACUCGCUGAGGAUCCGAGA |
| BCE25 | 231049 | GGGAGGACGAUGCGG | AGUCUGACCCUGUUAUGGACUACCAUAUCAGAAAGGUACU | CAGACGACUCGCUGAGGAUCCGAGA |
| BCE26 | 231050 | GGGAGGACGAUGCGG | GGUGAUCCUCCCCCCCGCCUCGAAGAUUUGUGCACAUAUC | CAGACGACUCGCUGAGGAUCCGAGA |
| BCE27 | 231051 | GGGAGGACGAUGCGG | GCUACCAUCGUCUAGUGAGUCACCCUUAGUCAUCAAGGC | CAGACGACUCGCUGAGGAUCCGAGA |

Figure 23A:
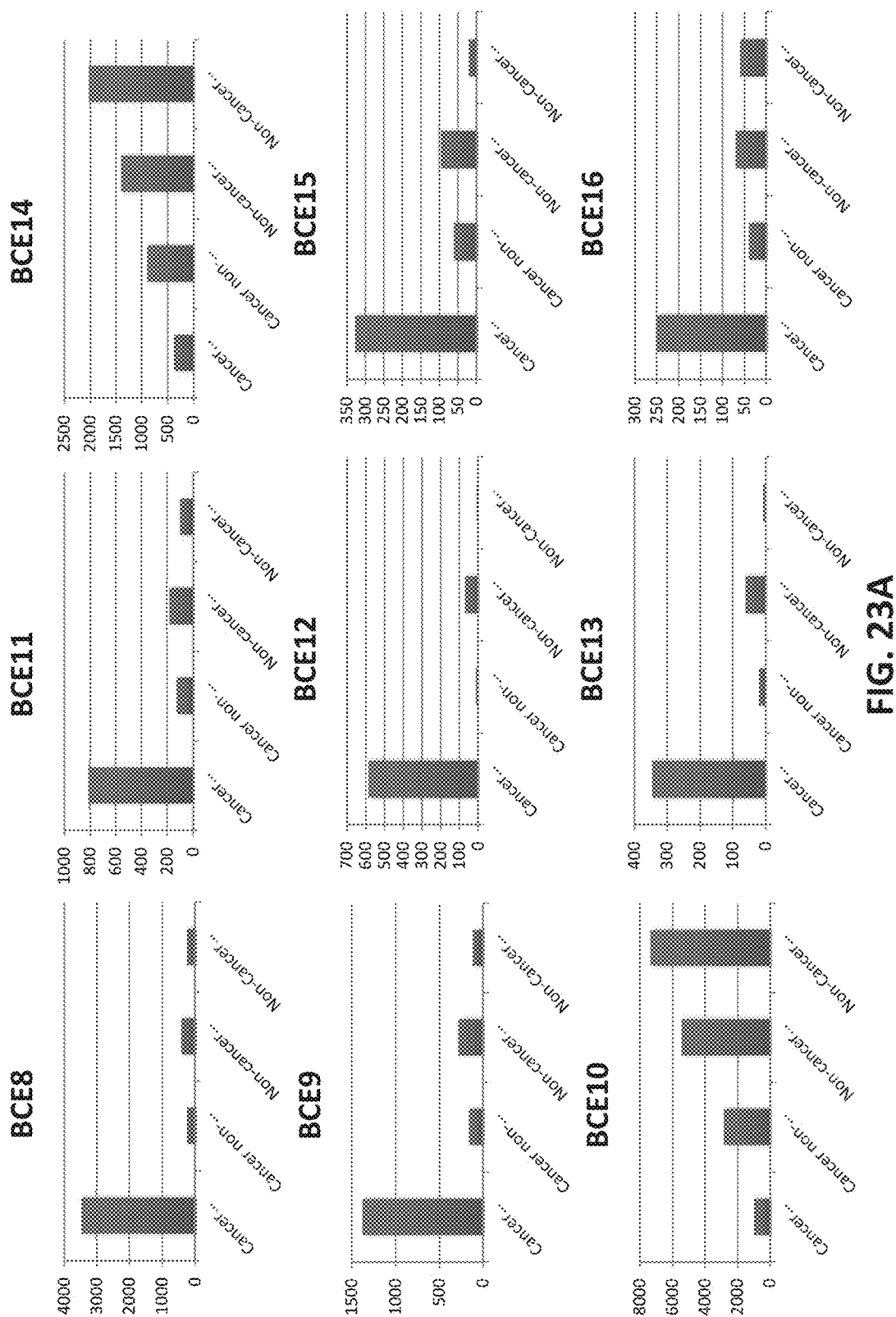
FIGS. 23A-C illustrate binding of selected aptamers against microbeads conjugated to various input samples. The aptamers were selected from an aptamer library as binding to microbeads conjugated to breast cancer-derived microvesicles. Experimental details are in Example 20. Each plot shows results obtained with the aptamer indicated above the plot. The Y-axis indicates level of binding. In each group of samples, binding of 9 purified aptamer candidates is shown. The input sample is indicated on the X axis from left to right as follows: 1) Cancer Exosome: aptamer binding to microbeads conjugated to microvesicles isolated from plasma samples from breast cancer patients; 2) Cancer Non-exosome: aptamer binding to microbeads conjugated to plasma samples from breast cancer patients after removal of microvesicles by ultracentrifugation; 3) Non-Cancer Exosome: aptamer binding to microbeads conjugated to microvesicles isolated from plasma samples from normal (i.e., non-breast cancer) patients; 4) Non-Cancer Non-Exosome: aptamer binding to microbeads conjugated to plasma samples from breast cancer patients after removal of microvesicles by ultracentrifugation.
Figure 23B:
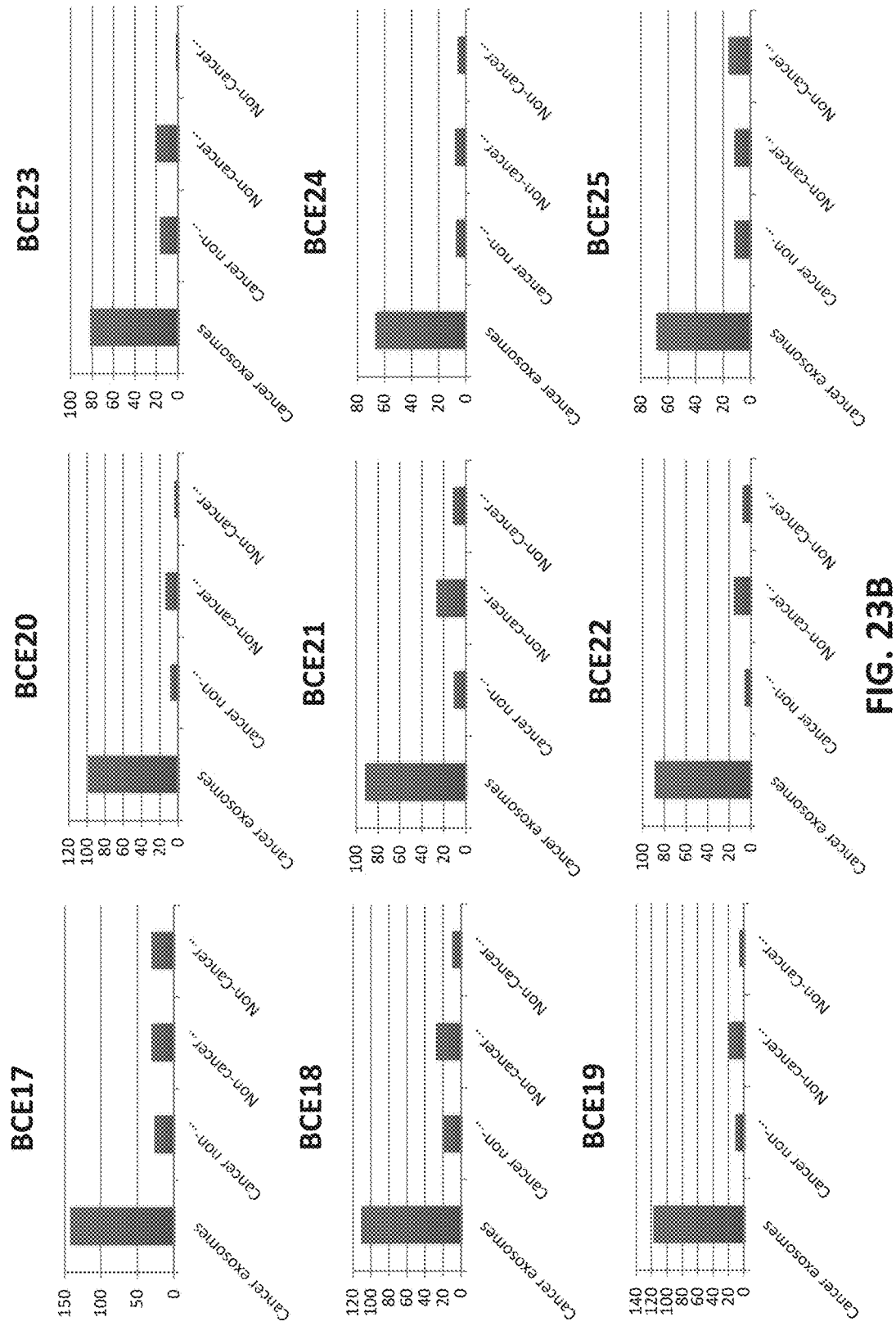
Figure 23C:
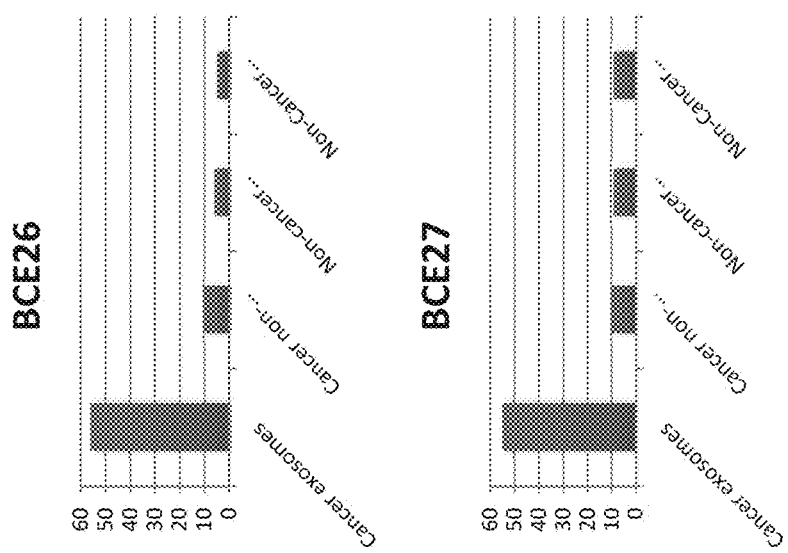

FIGS. 23A-C show binding of the indicated aptamers in Table 24 against microbeads conjugated to various input samples. The aptamer is indicated above each plot. See Table 24. The input sample is indicated on the X axis from left to right as follows: 1) Cancer Exosome: aptamer binding to microbeads conjugated to microvesicles isolated from plasma samples from breast cancer patients; 2) Cancer Non-exosome: aptamer binding to microbeads conjugated to plasma samples from breast cancer patients after removal of microvesicles by ultracentrifugation; 3) Non-Cancer Exosome: aptamer binding to microbeads conjugated to microvesicles isolated from plasma samples from normal (i.e., non-breast cancer) patients; 4) Non-Cancer Non-Exosome: aptamer binding to microbeads conjugated to plasma samples from breast cancer patients after removal of microvesicles by ultracentrifugation. As shown in FIGS. 23A-C, the aptamers were each able to distinguish between the cancer microvesicle samples versus the supernatant control samples and the non-cancer microvesicles. Further, all sequences in Table 24 were observed as binding more abundantly to cancer derived microvesicles as compared to non-cancer derived microvesicles with the exception of BCE10 and BCE14, which were observed as binding more abundantly to non-cancer derived microvesicles as compared to cancer derived microvesicles.

Based on the comparisons performed in this Example, aptamers that bind different starting input are obtained, including: 1) aptamers that preferentially bind cancer-derived microvesicles over non-cancer derived microvesicles; 2) aptamers that preferentially bind non-cancer-derived microvesicles over cancer derived microvesicles; 3) aptamers that bind both non-cancer-derived microvesicles and cancer derived microvesicles (e.g., "universal" binders); and 4) aptamers that bind plasma components that have been depleted of microvesicles.

The aptamer libraries in this Example are further subjected to four rounds of additional negative and positive selection. The positive selection is performed as described in this Example. The negative selection rounds are performed using the beads conjugated to non-cancer microvesicles as negative selection for aptamers obtained by positive selection against beads conjugated to cancer microvesicles. Similarly, the negative selection rounds are performed using the beads conjugated to cancer microvesicles as negative selection for aptamers obtained by positive selection against beads conjugated to non-cancer microvesicles.

Example 21: Disease Diagnosis

This Example illustrates the use of the aptamers of the present invention to diagnose a proliferative disease.

A suitable quantity of an aptamer that binds a cancer-derived microvesicle is synthesized via chemical means known in the art. The aptamers are conjugated to a diagnostic agent suitable for detection, such as a fluorescent moiety, using a conjugation method known in the art.

The composition is applied to microvesicles isolated from blood samples taken from a test cohort of patients suffering from a proliferative disease associated with the overexpression of microvesicles, e.g., prostate, breast, or lung cancer. The composition is likewise applied to microvesicles isolated from blood samples taken from a negative control cohort, not suffering from a proliferative disease.

The use of appropriate detection techniques (e.g., microbead assay or flow cytometry) on the test cohort samples indicates the presence of disease, while the same techniques applied to the control cohort samples indicate the absence of disease.

The results show that the aptamers of the present invention are useful in diagnosing proliferative diseases.

Example 22: Therapeutic Aptamers

This Example illustrates the use of the aptamers of the present invention to treat a proliferative disease in a mouse.

A suitable quantity of an aptamer that binds a cancer-derived microvesicle is synthesized via chemical means known in the art. The aptamers are conjugated to a chemotherapeutic agent using a conjugation method known in the art. The conjugate is formulated in an aqueous composition.

The composition is administered intravenously, in one or more doses, to a test cohort of mice suffering from a proliferative disease associated with the overexpression of the microvesicles, e.g., prostate, breast, or lung cancer model. A control cohort, not suffering from a proliferative disease is administered the identical composition intravenously, according to a corresponding dosage regimen.

Pathological analysis of tumor samples and/or mouse survival indicate that mortality and/or morbidity are improved in the test cohort over the control cohort.

The results show that the aptamers of the present invention are useful in treating proliferative diseases.

Useful aptamers can be used to treat the cancer in other organisms, e.g., a human.

Example 23: Aptamer—Sequencing Detection Method

This Example illustrates the use of an aptamer pool to detect microvesicles that are indicative of a phenotype of interest. The method makes use of a pool of aptamer that have been enriched against a target of interest that is indicative of a phenotype of interest. The method in this Example allows efficient use of a library of aptamers to preferentially recognize a target entity.

For purposes of illustration, the method is described in the Example with a microvesicle target from a bodily fluid sample. One of skill will appreciate that the method can be extended to other types of target entity (e.g., cells, proteins, various other biological complexes), sample (e.g., tissue, cell culture, biopsy, other bodily fluids) and other phenotypes (other cancers, other diseases, etc) by enriching an aptamer library against the desired input samples.

General Workflow:

1) Obtain sample (plasma, serum, urine or any other biological sample) of patients with unknown medical etymology and pre-treating them accordingly to ensure availability of the target of interest (see below). Where the target of interest is a microvesicle population, the microvesicles may be isolated and optionally tethered to a solid support such as a microbead.

2) Expose sample to an aptamer pool carrying certain specificity against target of interest. As described herein, an aptamer pool carrying certain specificity against the target of interest can be enriched using various selection schemes, e.g., using non-cancer microvesicles for negative selection and cancer microvesicles for positive selection as described above. DNA or RNA aptamers can be used as desired.

3) Contact aptamer library with the sample.

4) Elute any aptamers bound to the target.

5) Sequence the eluted aptamer. Next generation sequencing methods can be used.

6) Analyze aptamer profile from the sequencing. A profile of aptamers known to bind the target of interest indicates the presence of the target within the input sample. The profile can be used to characterize the sample, e.g., as cancer or non-cancer.

Protocol Varitions:

There are currently four basic protocols serving the purpose of aptamer-sequencing assay. Samples can be any biological sample.

Protocol 1:

Ultracentrifugation of 1-5 ml bodily fluid samples (e.g., plasma/serum/urine) (120K×g, no sucrose) with two washes of the precipitate to isolate microvesicles.

Measure total protein concentration of recovered sample containing the isolated microvesicles.

Conjugate the isolated microvesicles to magnetic beads (for example MagPlex beads (Luminex Corp. Austin Tex.)).

Incubate conjugated microvesicles with aptamer pool of interest.

Wash unbound aptamers by retaining beads using magnet.

Elute aptamers bound to the microvesicles.

Amplify and purify the eluted aptamers.

Aptamer sequencing (for example, Next generation methods; Ion Torrent: fusion PCR, emulsion PCR, sequencing).

Assess aptamer profile.

Protocol 2:

This alternate protocol does not include a microvesicle isolation step, microvesicles conjugation to the beads, or separate partitioning step. This may present non-specific binding of the aptamers agains the input sample.

Remove cells/debris from bodily fluid sample and dilute sample with PBS containing $MgCl_2$ (2 mM).

Pre-mix sample prepared above with aptamer library.

Ultracentrifugation of aptamer/sample mixture (120K×g, no sucrose). Wash precipitated microvesicles.

Recover precipitate and elute aptamers bound to microvesicles.

Amplify and purify the eluted aptamers.

Aptamer sequencing (for example, Next generation methods; Ion Torrent: fusion PCR, emulsion PCR, sequencing).

Assess aptamer profile.

Protocol 3:

This protocol uses filtration instead of ultracentrifugation and may require less time and sample volume.

Remove cells/debris from bodily fluid sample and dilute it with PBS containing $MgCl_2$ (2 mM).

Pre-mix sample prepared above with aptamer library.

Load sample into filter (i.e., 150K or 300K MWCO filter or any other that can eliminate unbound or unwanted aptamers). Centrifuge sample to concentrate. Concentrated sample should contain microvesicles.

Wash concentrate. Variant 1: Dilute concentrate with buffer specified above to the original volume and repeat centrifugation. Variant 2: Dilute concentrate with buffer specified above to the original volume and transfer concentrate to new filter unit and centrifuge. Repeat twice.

Recover concentrate and elute aptamers bound to microvesicles.

Amplify and purify the eluted aptamers.

Aptamer sequencing (for example, Next generation methods; Ion Torrent: fusion PCR, emulsion PCR, sequencing).

Assess aptamer profile.

Protocol 4:

Ultracentrifugation of 1-5 ml bodily fluid sample (120K× g, no sucrose) with 2 washes of the precipitate to isolate microvesicles.

Pre-mix microvesicles with aptamer pool.

Load sample into 300K MWCO filter unite and centrifuge (2000×g). Concentration rate is ~3×.

Wash concentrate. Variant 1: Dilute concentrate with buffer specified above to the original volume and centrifuge. Repeat twice. Variant 2: Dilute concentrate with buffer specified above to the original volume and transfer concentrate to new filter unit and centrifuge. Repeat twice Recover concentrate and elute aptamers bound to microvesicles.

Amplify and purify the eluted aptamers.

Aptamer sequencing (for example, Next generation methods; Ion Torrent: fusion PCR, emulsion PCR, sequencing).

Assess aptamer profile.

Example 24: Detection of Cancer Derived Microvesicle Using Aptamer Sequencing The method in Example 23 above is used to detect microvesicles in a bodily fluid sample that are derived from cancer cells. The microvesicles may be shed from the cancer cells. The aptamer library comprises a subset of aptamers described in Examples 18-20 above that preferentially bind to microvesicles from cancer patients versus non-cancer individuals. The sequences are listed herewith as SEQ ID NOs. 231032-241535. The method is used to detect the presence or absence of microvesicles that are indicative of cancer.

The test sample comprises plasma samples that are collected from patients having or suspected of having a cancer. A test sample is a sample to be characterized by the methods of the invention. The method is performed to determine the presence or absence of cancer derived microvesicles in the circulation of the patient.

The method is further used to detect evidence of cancer prior to biopsy. The test sample comprises plasma samples that are collected from patients scheduled to undergo a biopsy. The test sample is a sample to be characterized by the methods of the invention. The method is performed to determine the presence or absence of cancer derived microvesicles in the circulation of the patient prior to biopsy. If cancer-derived microvesicles are not detected, a decision may be made to forego biopsy.

Example 25: Aptamer Selection for Microvesicles

Classic aptamer selection techniques (i.e., SELEX) are typically performed to enrich aptamers for the particular target in "clean" conditions when interference with non-target molecules (competitors) is minimized. However, various applications for the selected aptamers require that the aptamers work to bind their target in diverse environments, e.g., in a biological sample or tissue culture media with an abundance of potentially interfering molecules. In this case, such interfering molecules which were not present during the selection process may interfere with target recognition by aptamers selected in ideal conditions. This Example provides an aptamer selection process to screen an aptamer library in order to select aptamers highly specific for the targets and also able to perform in a biological sample comprising the potentially interfering molecules.

In this Example, the target comprises a microvesicle such that an aptamer library is screened for members that bind cancer-derived microvesicles as compared to normal (non-cancer controls) microvesicles. One of skill will appreciate that the method can be extended to other types of target entity (e.g., cells, proteins, various other biological complexes). The method can employ various sample types (e.g., tissue, cell culture, biopsy, other bodily fluids) and can be directed to target molecules that can be used to characterize various phenotypes (various cancers, other diseases, etc) by enriching an aptamer library against the desired input samples. In addition, the cancer and normal samples can be switched to screen for aptamers that preferentially bind the normal samples.

Variant 1:

Microvesicle based aptamer selection in competition with plasma depleted from microvesicles. Workflow:

Microvesicles are isolated from cancer and normal plasma samples using ultracentrifugation. The supernatant comprising microvesicle depleted sample is stored as a negative control sample.

Capture/conjugate the isolated microvesicles to magnetic beads.

Start the aptamer screening and selection process using microvesicle conjugated beads mixed with supernatant from above (i.e., microvesicle depleted plasma). Supplement supernatant with $MgCl_2$. Aptamer screening and selection for cancer-derived and normal (non-cancer derived) microvesicles can be done in parallel. Each round consists of negative and positive selections as desired.

Since the initial aptamer library is exposed simultaneously to microvesicle targets as well as competitors (soluble proteins) from plasma, aptamers recovered from the microvesicles/beads may be more specific for the targets on microvesicle membrane. Such aptamers may perform effectively in biological samples without requiring extensive purification of the target prior to target binding/detection.

Variant 2:

Aptamer selection for cancer-derived microvesicles (e.g., shed from cancer cells) in competition with microvesicles isolated from normal samples. Workflow:

Microvesicles are isolated from cancer and normal plasma samples using ultracentrifugation.

Capture/conjugate the isolated cancer-derived microvesicles to magnetic beads.

Start the aptamer screening and selection process using cancer microvesicles conjugated beads mixed with normal microvesicles (non-conjugated) supplemented with $MgCl_2$. Aptamer screening and selection is performed for the cancer-derived microvesicles only by retaining only the aptamers that are retained with the magnetic beads.

Since aptamer library will be exposed simultaneously to both types of microvesicles (cancer and normal), the method selects aptamers that preferentially bind cancer-derived microvesicles in the presence of non-cancer microvesicles.

Variant 3:

Aptamer selection for cancer-derived microvesicles (e.g., shed from cancer cells) in competition with normal plasma (non microvesicles depleted). Workflow:

Microvesicles are isolated from cancer plasma samples using ultracentrifugation.

Capture/conjugate the isolated cancer-derived microvesicles to magnetic beads.

Start the aptamer screening and selection process using cancer microvesicles conjugated beads mixed with normal plasma (non-conjugated) supplemented with $MgCl_2$. Aptamer screening and selection is performed for cancer microvesicles only by retaining only the aptamers that are retained with the magnetic beads.

This approach combines advantages form Variants 1 and 2 above. Each round includes competition with normal plasma. Aptamers should be more selective for target in the presence of interfering plasma proteins and other biological entities.

Variant 4:

Parallel Cancer/Normal aptamer selection on mixed beads. Workflow:

Capture/conjugate cancer-derived microvesicles to magnetic beads

Capture/conjugate normal (non-cancer) microvesicles to non-magnetic beads

Mix both bead sets and perform the aptamer screening and selection process with the starting aptamer library Separate the magnetic and non-magnetic beads after incubation with aptamer library. Use a magnet to capture the magnetic beads then centrifuge to separate the nonmagnetic beads.

Wash the separated magnetic and non-magnetic beads separately.

Elute and re-amplify aptamers from both types of beads separately.

Round 2: mix amplified aptamer pools from both types of beads and add to the mixed beads Repeat from above Advantages of variant 4 include: (i) using same aliquot of aptamer library to start the aptamer screening and selection process for both cancer and non-cancer microvesicles; (ii) using competition between cancer and non-cancer microvesicles directly in one mixture in each round; (iii) supernatant can be added as additional competitor to increase selection stringency; (iv) parallel enrichment for cancer and non-cancer specific aptamers in competition to result in aptamers identifying only normals or only cancer (since there is a choice to bind either one).

Example 26: Selection of Universal Blocking DNA Aptamers for Carboxyl Groups

Blocking buffers known in the art generally comprise a mixture of synthetic peptides, BSA, trypsinized proteins, or random DNA pools (synthetic or natural, e.g., Salmon sperm DNA). These complex mixtures may contain molecules which besides blocking effect might provide additional false targets in an assay, thereby generating false positives.

In this Example, a blocking reagent was developed to serve as a specific blocker for a carboxylated substrate. The blocking reagent comprises an aptamer with minimized cross-reactivity to any other target than carboxyl groups on the substrate.

Preliminary experiments were done with five DNA aptamer libraries with $10^{15}$ sequences each and variable lengths (60, 65, 70, 75, 80-mers) were pre-amplified and strand separated so that forward strand (non-biotinylated) serves as an aptamer. Multiple rounds of negative selection and positive selection were performed as described in Example 9 above.

To identify potential blocking aptamers, sequences commonly observed in the selection processes with different protein targets were identified. One aptamer sequence that was identified as one of the most abundant recovered from the above selection process was also identified in the final aptamer pool for each of the different target proteins. This aptamer was selected as the aptamer blocking candidate:

5'-GGTGTGGTTGGGGGTGGTGGAGGTGGGGTTT-GTGGTGGGA (SEQ ID NO. 230938)

Without being bound by theory, it is that sequences which are rich in guanine bind carboxyl groups on the substrate beads via hydrogen bonds. See FIGS. 16A and 16B. FIG. 16A illustrates hydrogen bonding between a portion of an aptamer 1601 to carboxyl groups 1602 attached to a planar substrate 1603. FIG. 16B illustrates hydrogen bonding between a portion of an aptamer 1601 to carboxyl groups 1602 attached to a microsphere substrate 1604. Carboxyl groups 1602 are further attached to an antibody 1605. Guanine is the only one nucleotide which can form two hydrogen bounds.

Testing

In order to test the blocking properties of the aptamer blocking candidate, the following experiment was performed:

To obtain the aptamer, the 40-mer PBP pool after positive selection, which contained the most of the sequence presented above, was PCR re-amplified, strand separated and ethanol precipitated. Some related sequences were also amplified but were not considered to affect the results at their lesser concentrations.

Figure 24A:
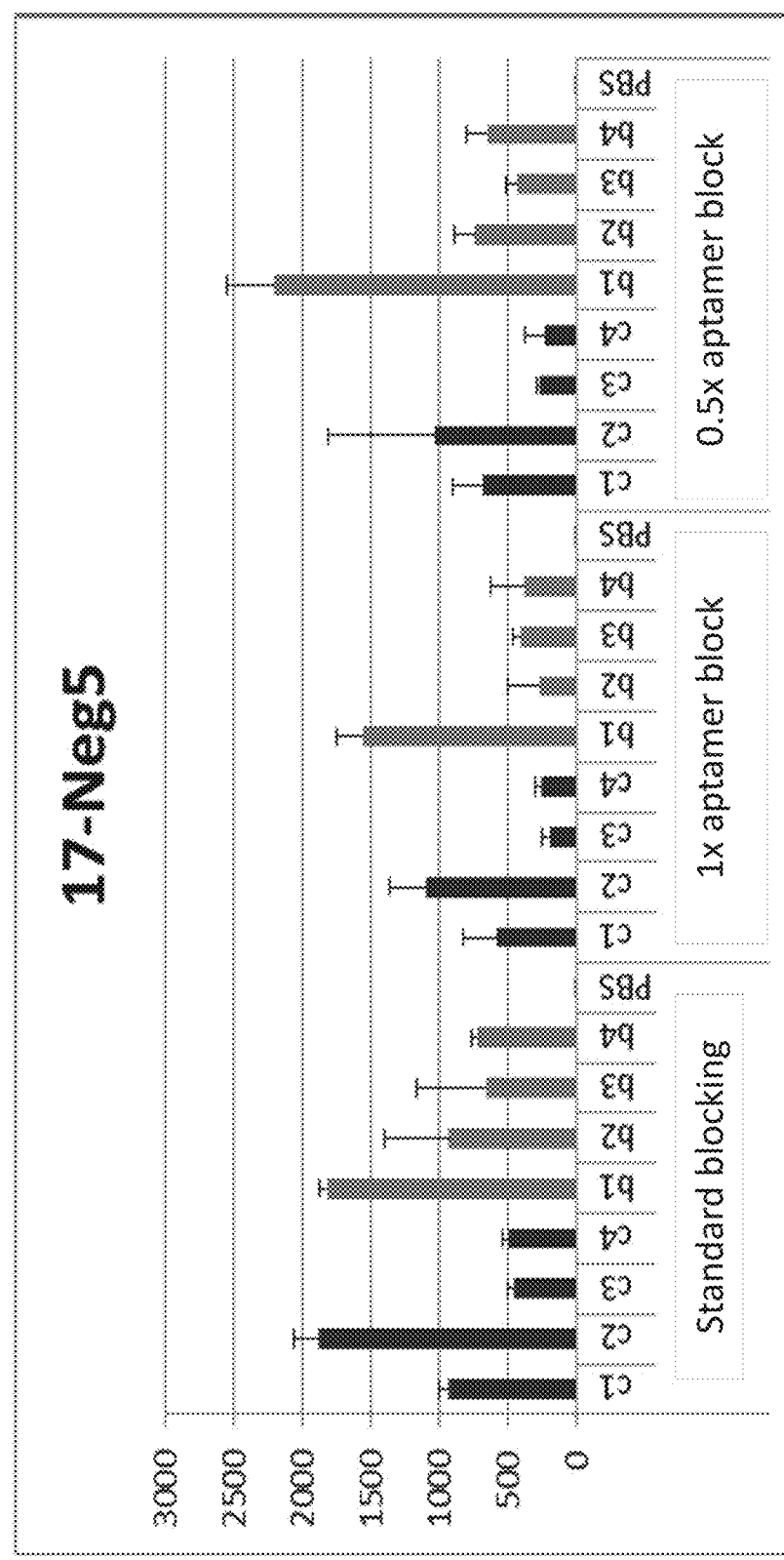
FIGS. 24A-24B illustrate detection of microvesicles in patient plasma samples. Microvesicles from the plasma samples were incubated with microbeads conjugated to antibodies to microvesicle antigens of interest. The bead-captured microvesicles were detected with a biotinylated anti-EpCAM aptamer and streptavidin-phycoerythrin (SAPE). The Y-axis shows fluorescent signal from bead-captured microvesicles. The X-axis shows bars for plasma from patients with prostate cancer (c1-c4), benign prostate conditions (b1-b4) and a PBS negative control. Different experimental conditions are indicated underneath the X-axis. Prior to incubation with the plasma samples, the antibody-conjugated beads were blocked with a standard blocking agent (StartingBlock Blocking Buffers, Thermo Fisher Scientific Inc., Rockford, Ill., USA), with the standard block and Ix concentration of a blocking aptamer of the invention (primarily SEQ ID NO. 230938), or with the standard block and 0.5× concentration of a blocking aptamer of the invention (primarily SEQ ID NO. 230938).
Figure 24B:
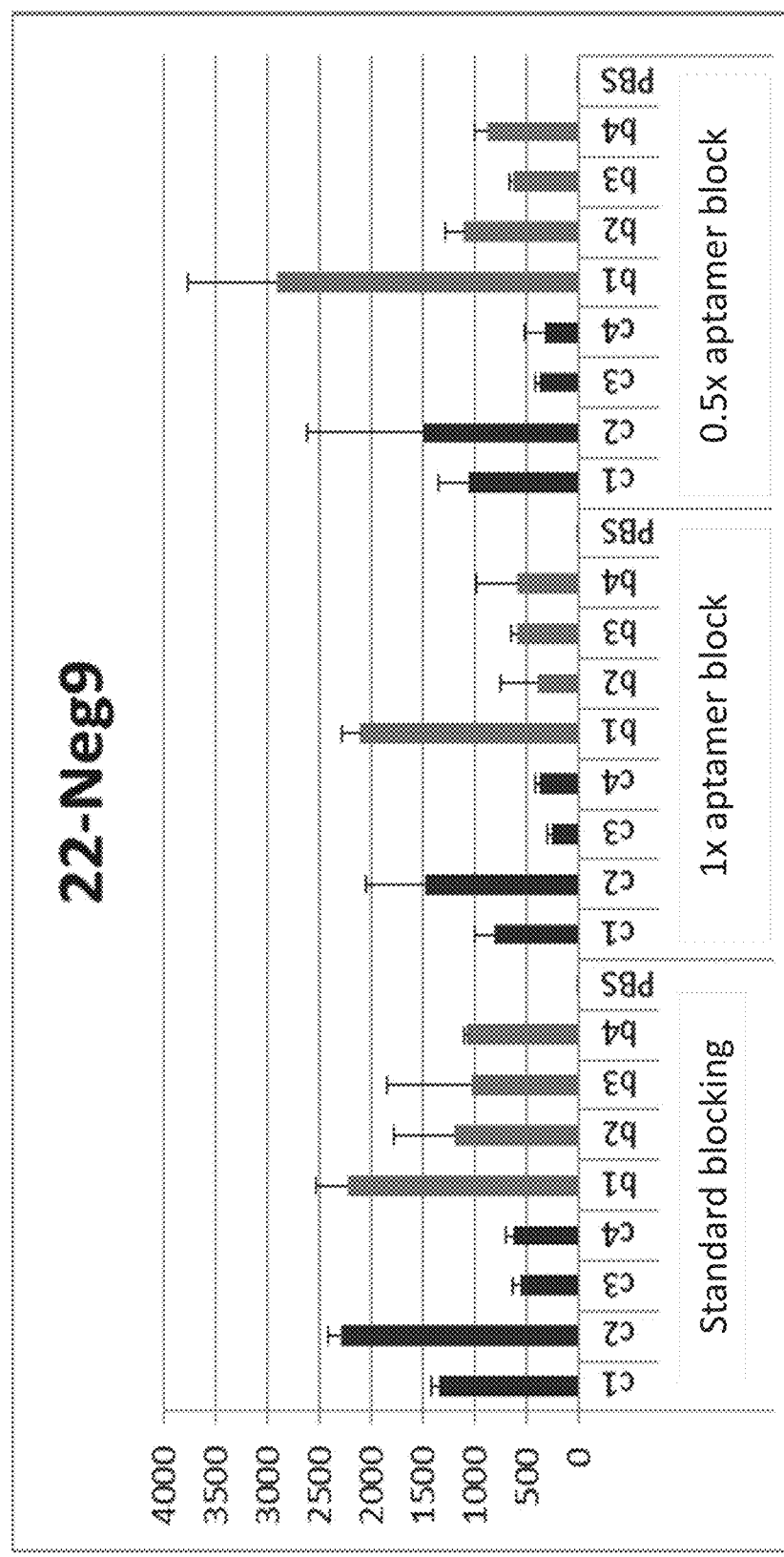

Microbeads conjugated to antibodies against the desired protein biomarkers (SSX4, PBP, SPDEF, EPCAM, KLK2, SSX2), to a negative control anti-IgG2B antibody, and to negative control aptamers (i.e., aptamers which are non-binding to any of the protein biomarkers, referred to as Neg5 and Neg9) were blocked with a solution comprising the above candidate blocking aptamer for 20 min. After incubating the antibody-conjugated microbead with the aptamer blocking candidate, standard microbead blocking solution was added and the beads were incubated for additional 20 min. The beads were then distributed into PCR strip tubes and mixed with plasma samples from patients with prostate cancer or benign prostate disorders. The mixture was incubated for 2 h at 37° C. The samples were transferred to the filter plates and mixed with a biotinylated anti-EpCAM aptamer that should recognize microvesicles captured by the antibody-conjugated microbeads. The beads were incubated with the anti-EpCAM aptamer for 1 h at room temperature. The plates were washed and Streptavidin-PE was added and samples were incubated for 30 minutes at room temperature. The plates were washed, and fluorescence of the PE in complex with the microbeads was measured with 100 µl solution of the sample. Each sample was tested in triplicate wells and results were averaged. Negative controls using an anti-IgG2b antibody and two non-binding aptamers were also run. Results are shown for the two non-binding aptamers, Neg5 and Neg9, are shown in FIGS. 24A-24B, respectively. The results as shown in FIGS. 24A-24B revealed lower background levels when beads were pre-blocked with standard blocking conditions (StartingBlock Blocking Buffers, Thermo Fisher Scientific Inc., Rockford, Ill., USA), standard blocking with 1× candidate blocking aptamer (~34 µg/ml), and to standard blocking with 0.5× aptamer blocking.

Because the blocking aptamers are rich in guanine, the experiments were repeated with a solution comprising a single guanine nucleotide only followed by the standard starting block. No improvements were observed using only the single nucleotide.

Example 27: Illustrative Blocking Aptamer Sequences

The following Table 25 comprises illustrative aptamers of the invention. The aptamers were part of the pool of aptamers described in Example 26 and were part of the common pool of blocking aptamers identified. It is understood that the nucleotide sequences that are disclosed in Table 25 can be modified to the extent that resulting modifications result in an aptamer having about 50, 55, 60, 65, 70, 75, 80, 85, 90, 95, 96, 97, 98, and 99 percent homology to the disclosed sequence and retain the functionality of binding carboxyl functional groups. As used in the context of any defined numerical unit herein, the term "about" means variance of 10% above or below that numerical unit and all units in between.

TABLE 25

Illustrative Aptamers

| Sequence 5'->3' | SEQ ID NO. |
|---|---|
| GGTGTGGTTG GGGGTGGTGG AGGTGGGGTT TGTGGTGGGA | 230938 |
| GGTGTGGGTT GGGGGTGGTG GAGGTGGGGT TTGTGGTGGG A | 230939 |
| GGTGTGGTTG GGGGTGGTGG AGGTGGGTTT GTGGTGGGA | 230940 |
| GGTGTGGGTT GGGGGTGGTG GAGGTGGGGT TTGTGGTGGG AG | 230941 |
| GGTGTGGGTT GGGGGTGGTG GAGGTGGGGT TTGTGGTGGG | 230942 |
| GGTGTGGGTT GGGGGTGGTG GAGGTGGGGT | 230943 |
| GGTGTGGGTT GGGGGTGGTG GAGG | 230944 |
| GGTGTGGGTT GGGGGTGGTG GAG | 230945 |
| GGTGTGGTTG GGGGTGGTGG AGGTGGGGTT TGTGGTGGGA G | 230946 |
| GTGGAGGTGG GGTTTGTGGT GGGA | 230947 |
| GGGTGGTGGA GGTGGGTTTG TGGTGGGA | 230948 |
| GGTGGTGGTT GGGGGTGGTG GAGGTGGGGT TTGTGGTGGG A | 230949 |
| GTGGAGGTGG GTTTGTGGTG GGA | 230950 |
| GGGTGGTGGA GGTGGGGTTT GTGGTGGGA | 230951 |
| CGTTGAAGGT TGGGCGGTTG GGGTGTGTGG GATTGGTGGG | 230952 |
| GGTGTGGTTG GGGGTGGTGG AGGTGGGGT | 230953 |
| GTGGGGTTTG TGGTGGGA | 230954 |

TABLE 25-continued

Illustrative Aptamers

| Sequence 5'->3' | SEQ ID NO. |
|---|---|
| CGCCTAGAGG TCGGGTGGTT GGGGTTGTGG GATGGGGGGT | 230955 |
| TGGTGTTGTC CTGTTGGCCT TTTGTTGTCG CACCCTCGCA | 230956 |
| GGTGTGGTTG GGGGTGGTGG AGGTGGGGTT TGTGGTGGG | 230957 |
| GGTGGAGGTG GGGTTTGTGG TGGGA | 230958 |
| GGTGTGGTTG GGGGTGGTGG AGG | 230959 |
| GGTGTGGTTG GGGTGGTGGA GGTGGGTTTG TGGTGGGA | 230960 |
| CTGCCTGGCA CGTCGCGTTT GTGTTCGTTG GTCGGTCAGG | 230961 |
| TGAGGGTGGG TGGTGGGTTG ATGTTGGTTG ATGGGGTGG | 230962 |
| GGTGGAGGTG GGTTTGTGGT GGGA | 230963 |
| GGTGTGGGTT GGGGTGGTGG AGG | 230964 |
| GGTGTGGGTT GGGGGTGG | 230965 |
| GGTGTTGTGG GGGTGTTTGT CG | 230966 |
| CGGTCTTGCT GGGTGGTCGT GCGGTGTTCG TGGTGGTGGT | 230967 |
| GGTGTGGTTG GGGTGGTGGA GGTGGGTTT GTGGTGGGA | 230968 |
| GGTGTGGTTG GGGGTGGTGG AGGTGGGTTG TGGTGGGA | 230969 |
| TGGTTGGGGG TGGTGGAGGT GGGGTTTGTG GTGGGA | 230970 |
| GGTGTGGGTT GGGGGTGGTG | 230971 |
| GGTTGGGGGT GGTGGAGGTG GGGTTTGTGG TGGGA | 230972 |
| GGTGTGGGTT GGGGTGGTGG AG | 230973 |
| GGTGTGGGTT GGGGGTGGTG GAGGTGGGGT TTG | 230974 |
| GGTGTGGTTG GGGTGGTGGA GGTGGGTTGT GGTGGGA | 230975 |
| GGTTTGTGGT GGGA | 230976 |
| GGTGTGGGTT GGGGGTGGTG GAGGTGGGGT TTGTGG | 230977 |
| GTGGAGGTGG GTTGTGGTGG GA | 230978 |
| TCACGTGCTT CATTTTTGTG TTCCCTCCTC CTGCTGCGCA | 230979 |
| GGTGTGGGTT GGGGGTGGTG GAGGTGGG | 230980 |
| GTGGTGGAGG TGGGTTTGTG GTGGGA | 230981 |
| GTGGTGGAGG TGGGGTTTGT GGTGGGA | 230982 |
| GGTGTTGGTG GGGGTGTTTG TCG | 230983 |
| GGGTGGTGGA GGTGGGTTGT GGTGGGA | 230984 |
| GTGTGGTTGG GGGTGGTGGA GGTGGGGTTT GTGGTGGGA | 230985 |
| TGGTGGGA | 230986 |
| AGGTGTGGTT GGGGGTGGTG GAGGTGGGGT TTGTGGTGGG A | 230987 |
| GTGGGTTGTG GTGGA | 230988 |
| GTGGGTTTGT GGTGGGA | 230989 |
| ACACGAACGC GCATTGTTTT CGCATCCTTC CTCCTTTCCA | 230990 |
| TGGGCGGGGG TGGTTGTATC TTCTATGGGA GGGGGTTGGC | 230991 |
| GGTGTGGGTT GGGGGTGGTG GAGGTGGGGT T | 230992 |

TABLE 25-continued

Illustrative Aptamers

| Sequence 5'->3' | SEQ ID NO. |
|---|---|
| GGTGTGGTTG GGGGTGGTGG AGGTGGGGTT GTGGTGGGA | 230993 |
| CGTGATGTGG GTGGGTGGTG GGCTTGGTGT GTGGGGTGG | 230994 |
| GGTGTGGGTT GGGGGTGGTG GAGGTGGGGT TGTGGTGGGA G | 230995 |
| GGTGTGGGTT GGGGTGGTGG AGGTGGGGTT TGTGGTGGGA | 230996 |
| GGTGTGGTTG GGGGTGGTGG AG | 230997 |
| GGTGTGGGTT GGGGTGGTGG AGGTGGGGT | 230998 |
| GGTGTGGTTG GGGGTGGTGG AGGTGGG | 230999 |
| GGTGTGGTTG GGGGTGGTGG AGGTGGGGTT TGTGG | 231000 |
| TGTGGTGGGA | 231001 |
| GGTGTGGGTT GGGGGTGGTG GAGGTGGGGT TTGGTGGTGG GAG | 231002 |
| GGTGTGGTTG GGGTGGTGGA GGTGGGTTGT GGTGGA | 231003 |
| GGGGTGGTGG AGGTGGGGTT TGTGGTGGGA | 231004 |
| GGTGTGGGTT GGGG | 231005 |
| GGTGTGGTTG GGGGTGGTG | 231006 |
| GCGGTCTTCG TTCGTCGTCG TGACCTCGTA TCTTTGGCTT | 231007 |
| GGTGTGGTTG GGGGTGGTGG AGGTGGGGTT TGTGGTGGA | 231008 |

Example 28: Microsphere Bound Microvesicles

Microvesicles can be bound to a substrate using various methods. In this Example, three methods are used to attach microvesicles to a substrate: 1) direct conjugation; 2) lipid anchoring; 3) antibody binding; and 4) aptamer binding. See schematics in FIGS. 7A-D. FIG. 7A illustrates direct conjugation of a carboxylated microsphere to a vesicle surface antigen. FIG. 7B illustrates anchoring of a microvesicle to a microsphere via a biotin functionalized lipid anchor. FIG. 7C illustrates antibody binding to a vesicle surface antigen, wherein the antibody is conjugated to a carboxylated microsphere. FIG. 7D illustrates aptamer binding to a vesicle surface antigen, wherein the aptamer is conjugated to a carboxylated microsphere. Microsphere attached microvesicles produced by the methods in this Example can be used to screen an aptamer library as described in the Examples above.

Figure 8A:
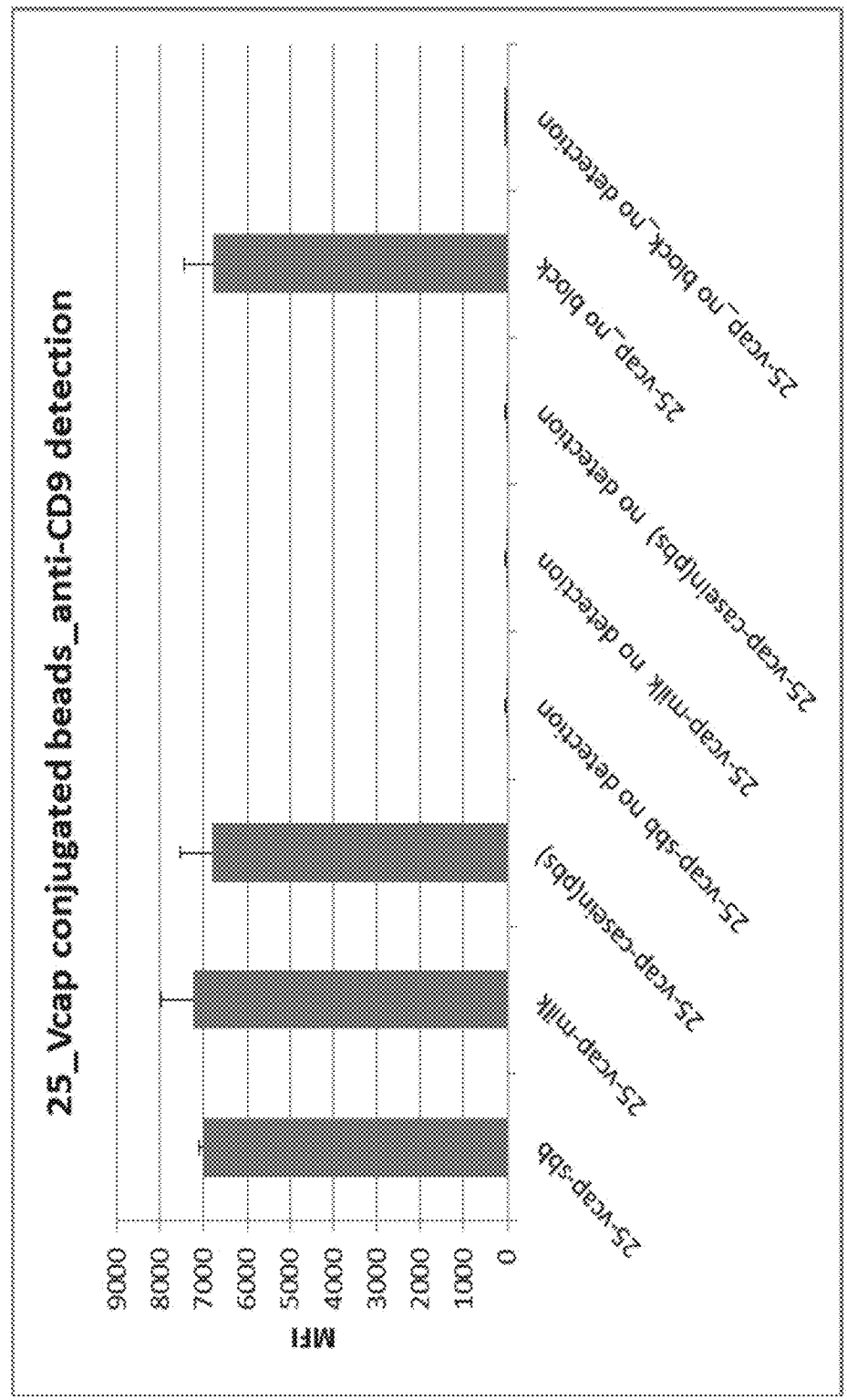
FIGS. 8A-8B illustrate detection of VCAP derived microvesicles conjugated to microspheres. The bead-conjugated vesicles were detected using MagPlex beads according to manufacturer's protocol (Luminex Corp., Austin Tex.). The microvesicles were detected with phycoerythrin (PE) labeled antibodies to CD9 (FIG. 8A) or CD63 (FIG. 8B), two common microvesicle surface proteins. The Y-axis in the figures shows median fluorescent intensity (MFI) of the detected microvesicles. Various experimental conditions are indicated along the X axis. Assays were performed with various blocking agents ("SBB": StartingBlock, Thermo Fisher Scientific Inc., Rockford, Ill.; "milk": dried milk blocking buffer; "Casein(pbs)": casein blocking buffer) or no blocking ("no block"). Controls were run without detectors where indicated.
Figure 8B:
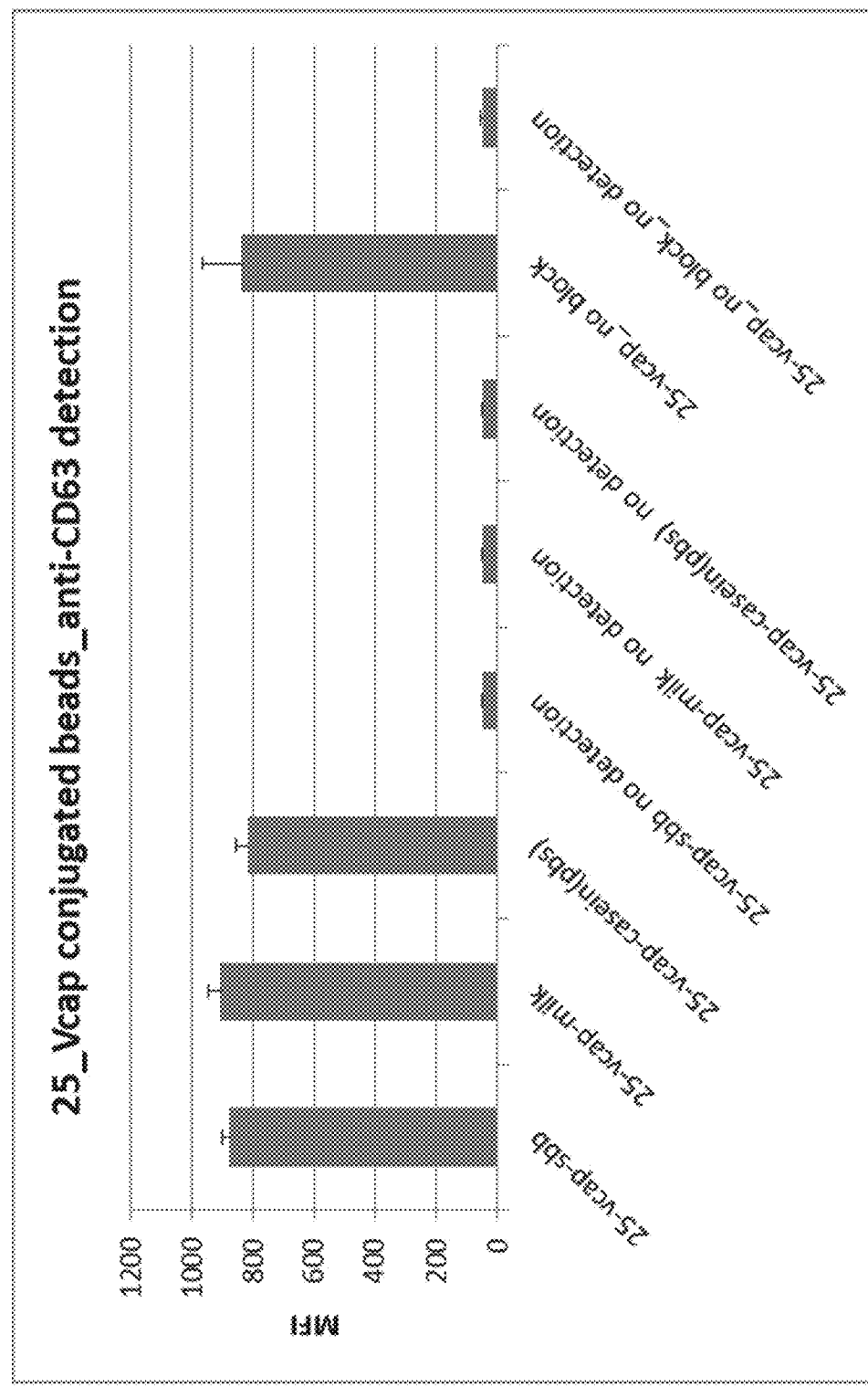

Direct Conjugation:

Direct conjugation of microvesicles to microspheres was tested using microvesicles released from the VCAP prostate cancer cell line. Protocol: VCAP microvesicles were conjugated to MagPlex beads (Luminex Corp, Austin Tex.) according to protocol established for antibodies (5 million beads, 20 µg microvesicles). See Example 29 below for detailed protocol. Isolated microvesicles were conjugated to carboxylated beads using standard two-step carbodiimide chemistry as known in the art. The MagPlex assay was performed according to manufacturer's protocol with 1200 beads per well. The beads were tested with three blocking buffers as well as without blocking to exclude any possible bead driven signals. To label the microvesicles, the beads were incubated with 5 µg/ml of PE labeled anti-tetraspanin detector antibodies (anti-CD9-PE and anti-CD63-PE) for 1 h at room temperature. Results are shown in FIGS. 8A-8B. As it seen from the figures, the bead-conjugated VCAP microvesicles were specifically detected with both detector antibodies. Further, the response to specific antibodies reflected the natural prevalence of CD9 and CD63 surface proteins in microvesicles (i.e., CD9 is more prevalent than CD63, which is reflected in the greater MFI values when using anti-CD9 detector antibodies (FIG. 8A) versus anti-CD63 detector antibodies (FIG. 8B)).

Figure 9A:
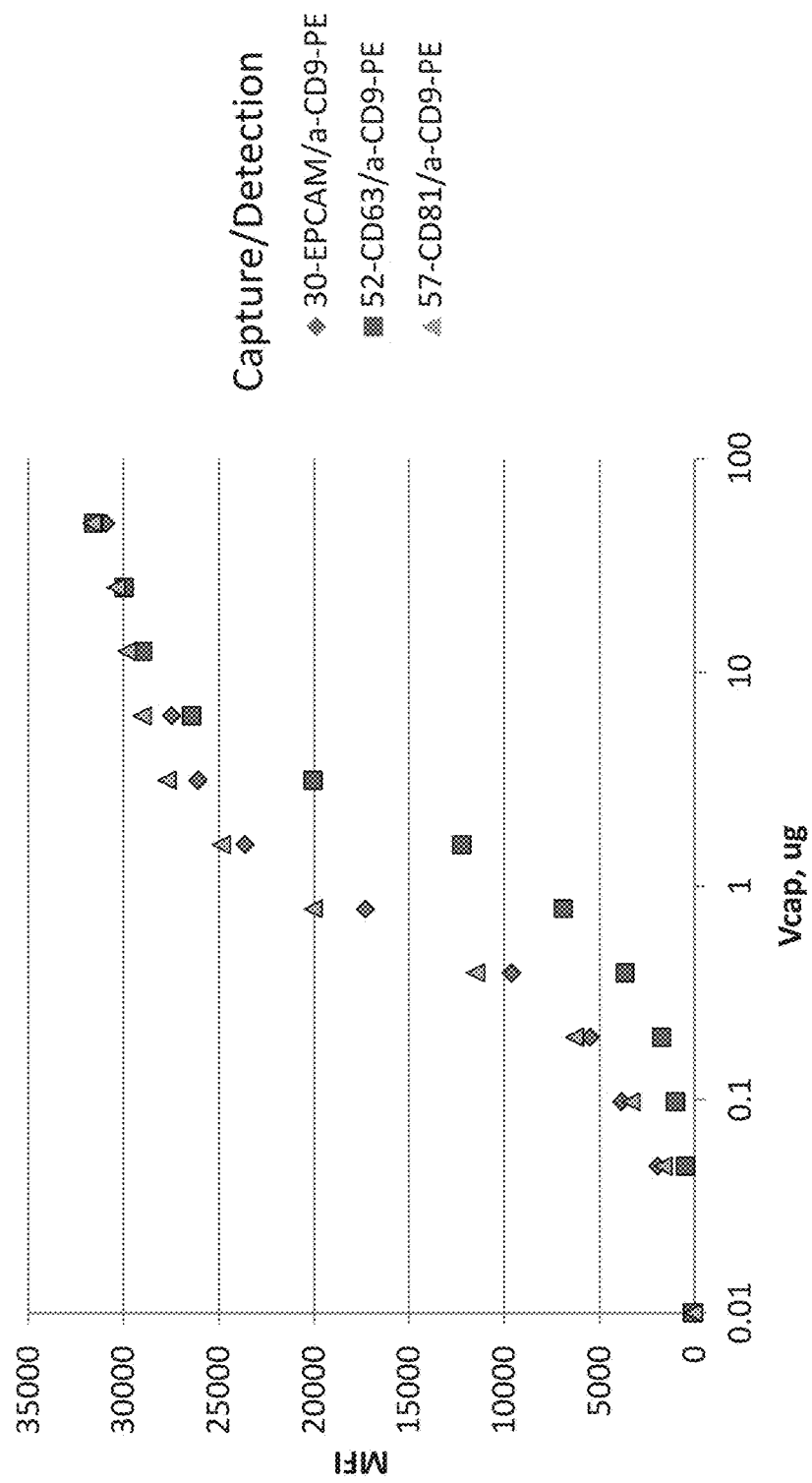
FIGS. 9A-9D illustrate capture of microvesicles using antibody-conjugated microspheres.
Figure 9B:
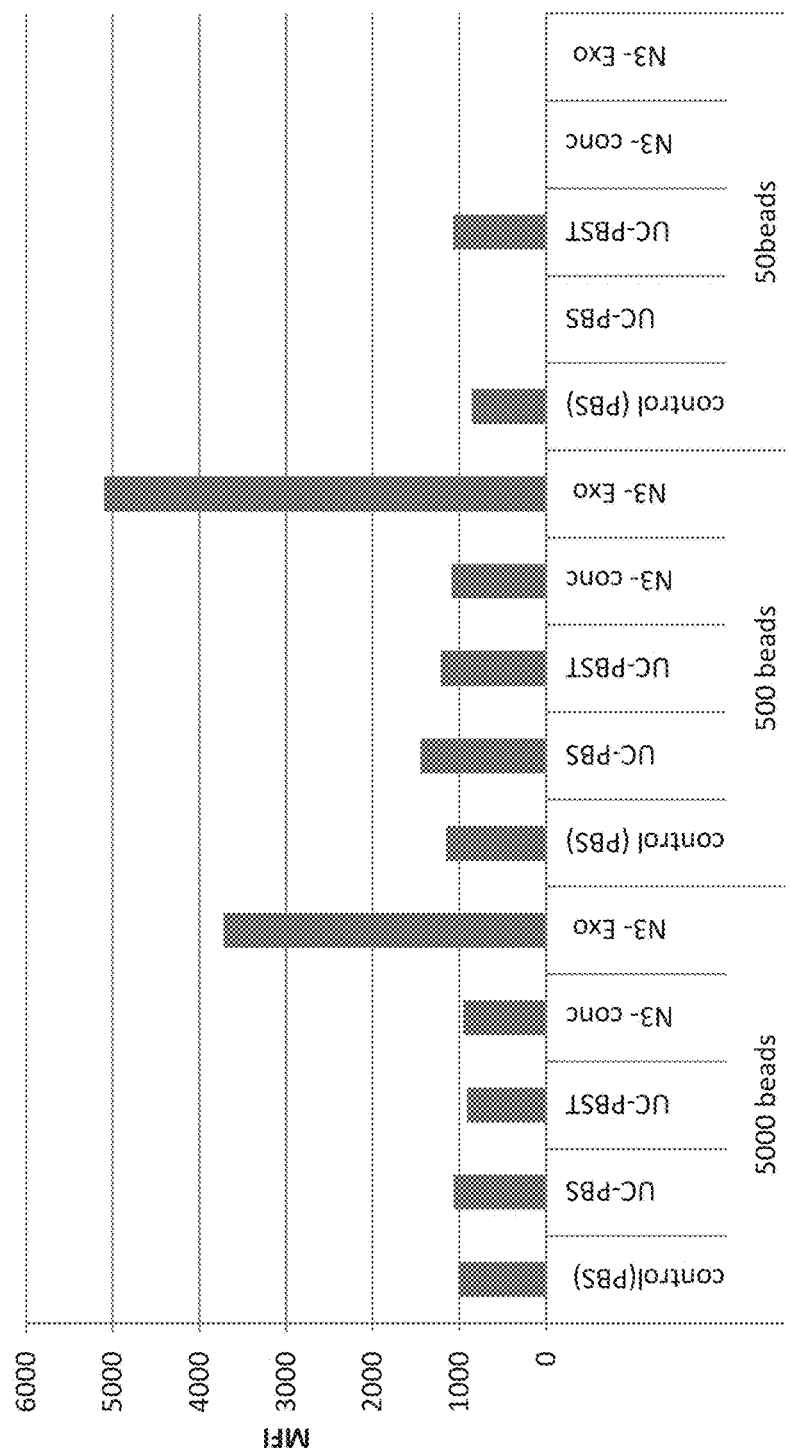
Figure 9C:
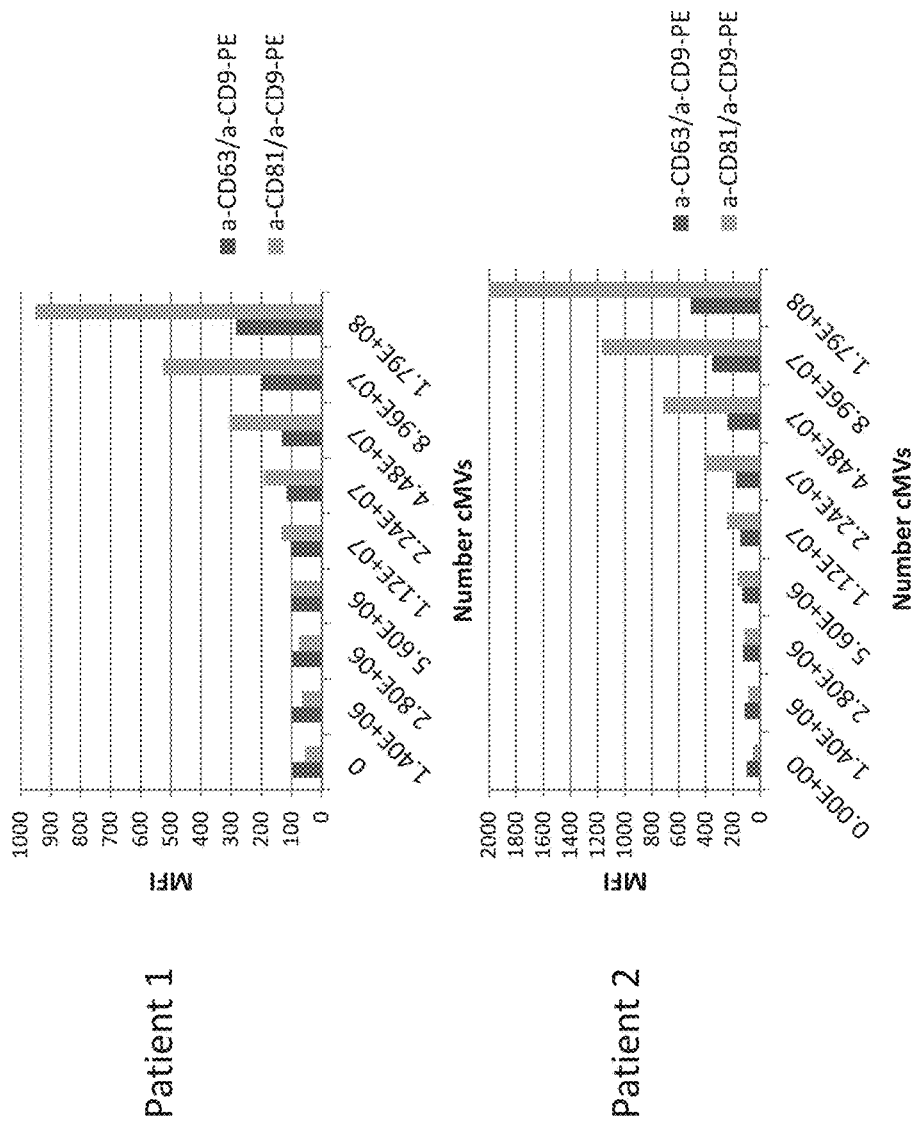
Figure 9D:
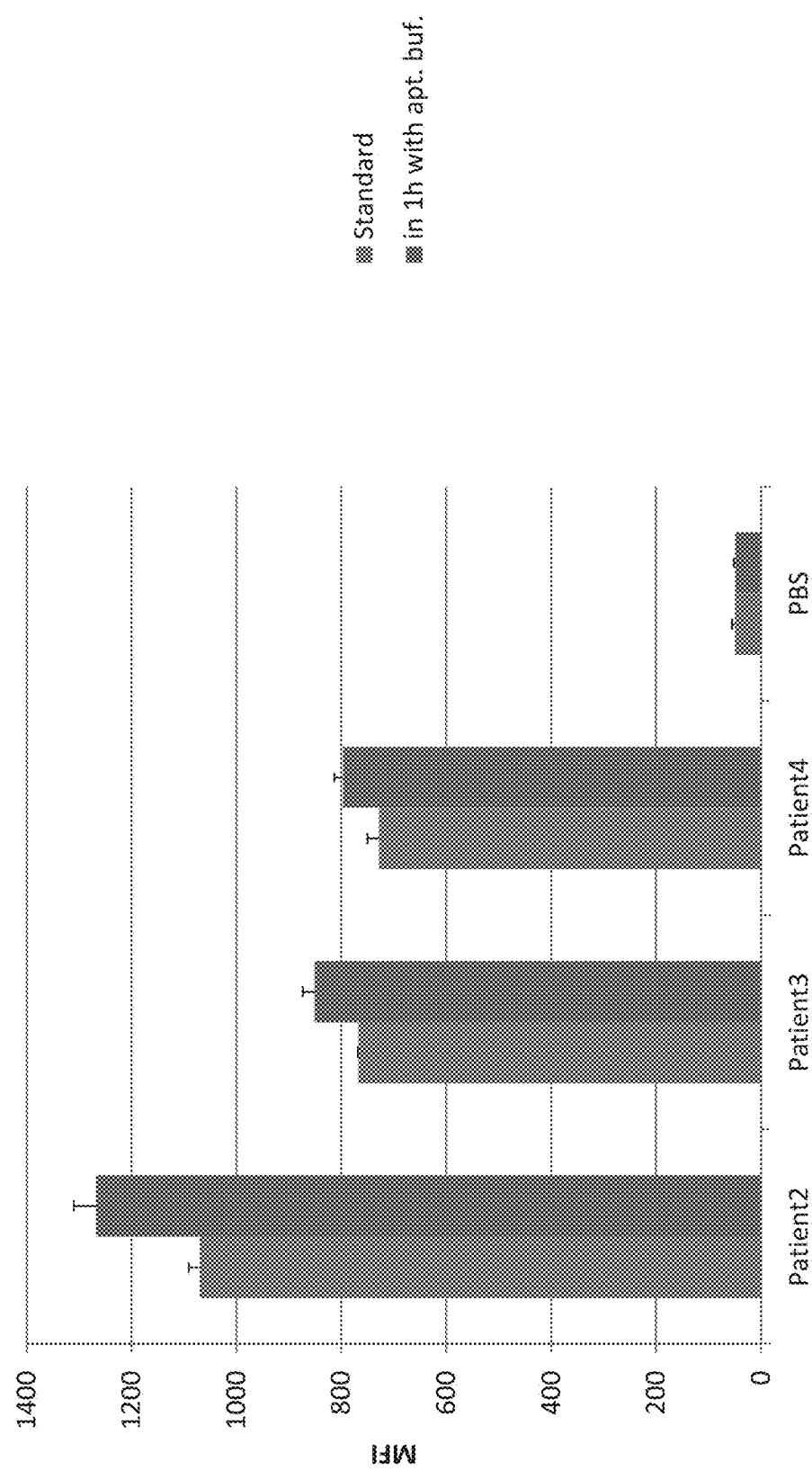

Antibody Binding:

MagPlex beads were conjugated with antibodies to EpCAM, CD63 or CD81 according to manufacturer's protocol (Luminex Corp., Austin Tex.). The microvesicles were detected with phycoerythrin (PE) labeled antibodies to CD9, a common microvesicle surface protein. The Y-axis in the figures shows median fluorescent intensity (MFI) of the detected microvesicles. Results are shown in FIGS. 9A-9E. As shown in FIGS. 9A and 9C, increasing amounts of vesicles from VCap cells (FIG. 9A) or patient plasma samples (FIG. 9C) resulted in increasing MFI signal. Sample preparation appeared to effect the signal detected, as Exo-Quick isolated vesicles yielded greater signal than those isolated with ultracentrifugation or ultracentrifugation. See FIG. 9B. Finally, the antibody-captured vesicles appeared to be stably tethered to the microbeads, as shown by stable signal after prolonged incubation. See FIG. 9D.

Lipid Anchoring:

VCAP microvesicles were conjugated to microspheres using the microvesicle lipid membrane as a conjugation target. A heterobifunctional crosslinker with a lipid functional group was used as shown in FIG. 10A. The linkage between the microsphere and microvesicle using the heterobifunctional crosslinker is as shown in FIG. 10B. Streptavidin coated beads are incubated with biotin functionalized lipid (the "lipid anchor"), washed and incubated with the desired microvesicles. As shown in FIG. 10B, the attachment of the lipid anchor with the microsphere is performed by streptavidin-biotin affinity, and capturing of the microvesicles is facilitated by phospholipid analog incorporation into the vesicle lipid bilayer membrane. The protocol is as follows:

1. Wash 600 µl of Streptavidin coated magnetic beads (Pierce cat#88817) twice with phosphate buffered saline (PBS).
2. Resuspend the beads in 500 µl of PBS only (as a control) or 500 µl PBS with 1 µl of functionalized lipid moiety [1,2-dihexadecanoyl-sn-glycero-3-phosphoethanolamine-N-(cap biotinyl)] (Avanti Polar Lipids, Alabaster Ala., cat#870277X; 1:1000 dilution in water). Incubate for 30 min at 37° C. with rotation.
3. Wash the beads with UltraPure water (Invitrogen cat#10977) then twice with PBS (HyClone cat#SH30256).
4. Add 100 µg of VCAP microvesicles or human plasma to the beads with or without the lipid anchor. Raise volume to 500 µl with PBS. Incubate for 1 h at 37° C. with rotation. Store for overnight at 4° C.
5. Pipet an aliquot of the beads needed for the following experiment, wash twice with PBS.
6. Test the presence of captured microvesicles with flow cytometry (MoFlo™ XDP instrument, Beckman Coulter, Inc., Indianapolis Ind.) using microvesicle specific antibodies PE-labeled anti-human CD9 (BD Pharmingen cat#555372) and PE-labeled anti-human CD63 (BD Pharmingen cat#556020), or an isotype control PE mouse IgG1 kappa (eBioscience cat#12-4714-42).
7. Samples were incubated for 1 hour at room temperature on an Eppendorf MixMate in the dark. The beads were then washed twice and resuspended in PBS, and analyzed on MoFlo XDP or Luminex 200.

Figure 10G:
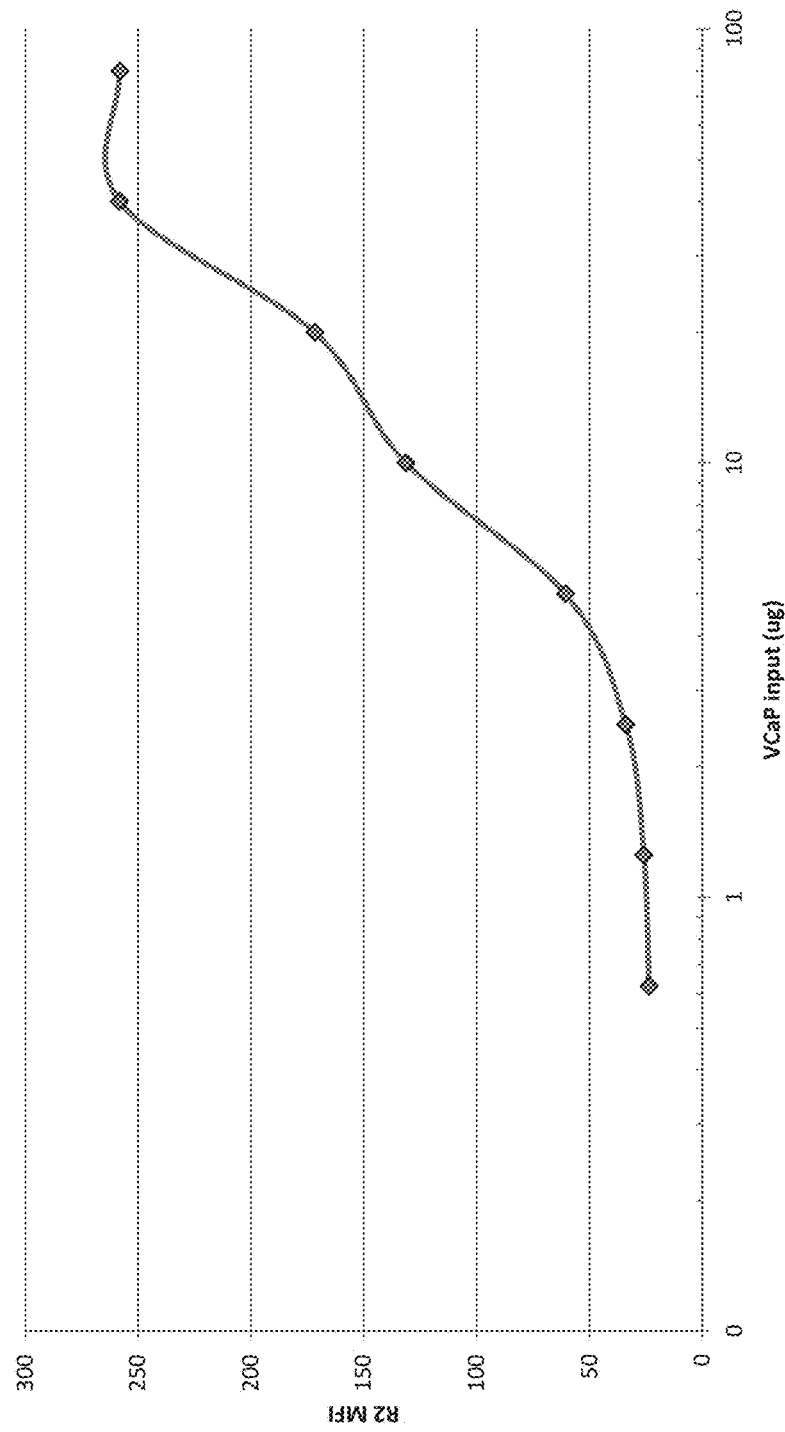
FIG. 10G illustrates titration of varying amounts of lipid-anchored vesicles detected as above.
Figure 10H:
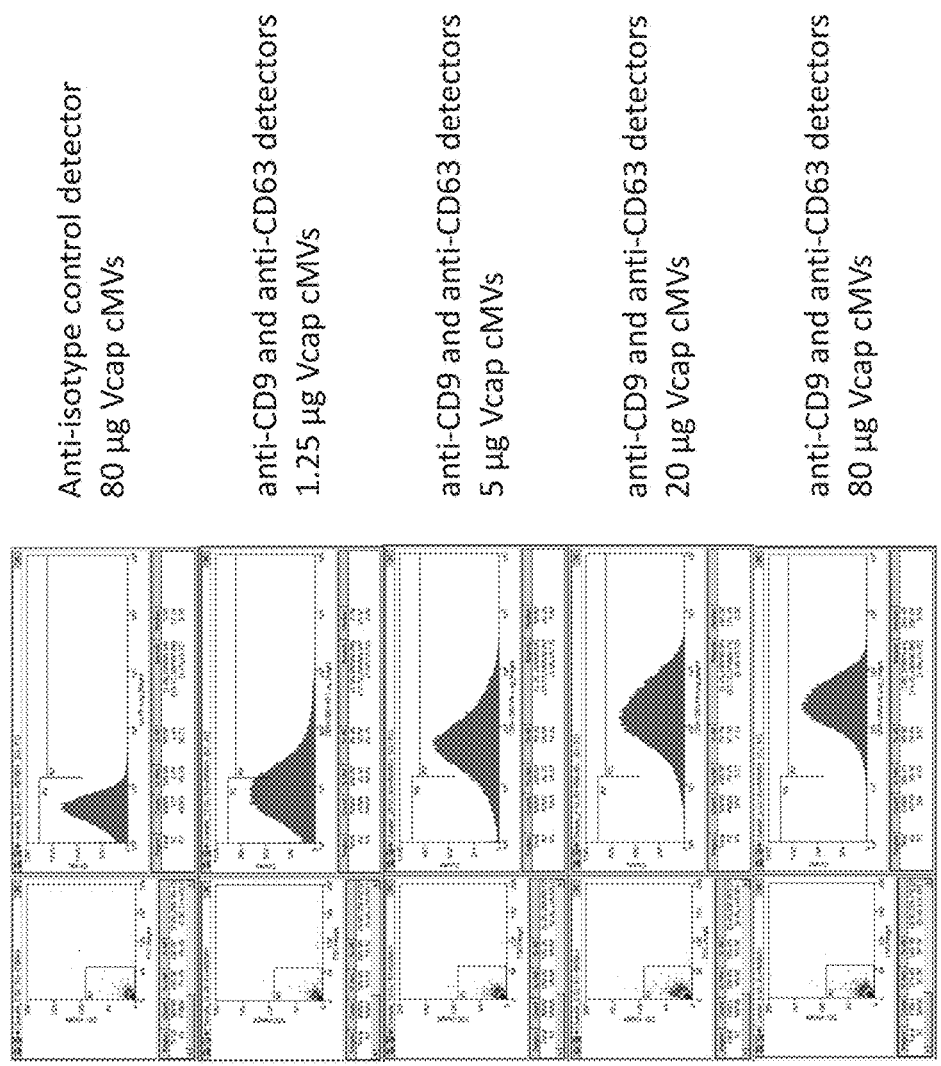
FIG. 10H illustrates another view of titration of varying amounts of lipid-anchored vesicles detected as above. The indicated amount of VCap vesicles (cMVs) were detected using either a PE labeled anti-Mouse IgG antibody as a control or PE labeled anti-CD9 and anti-CD63 antibodies.
Figure 10I:
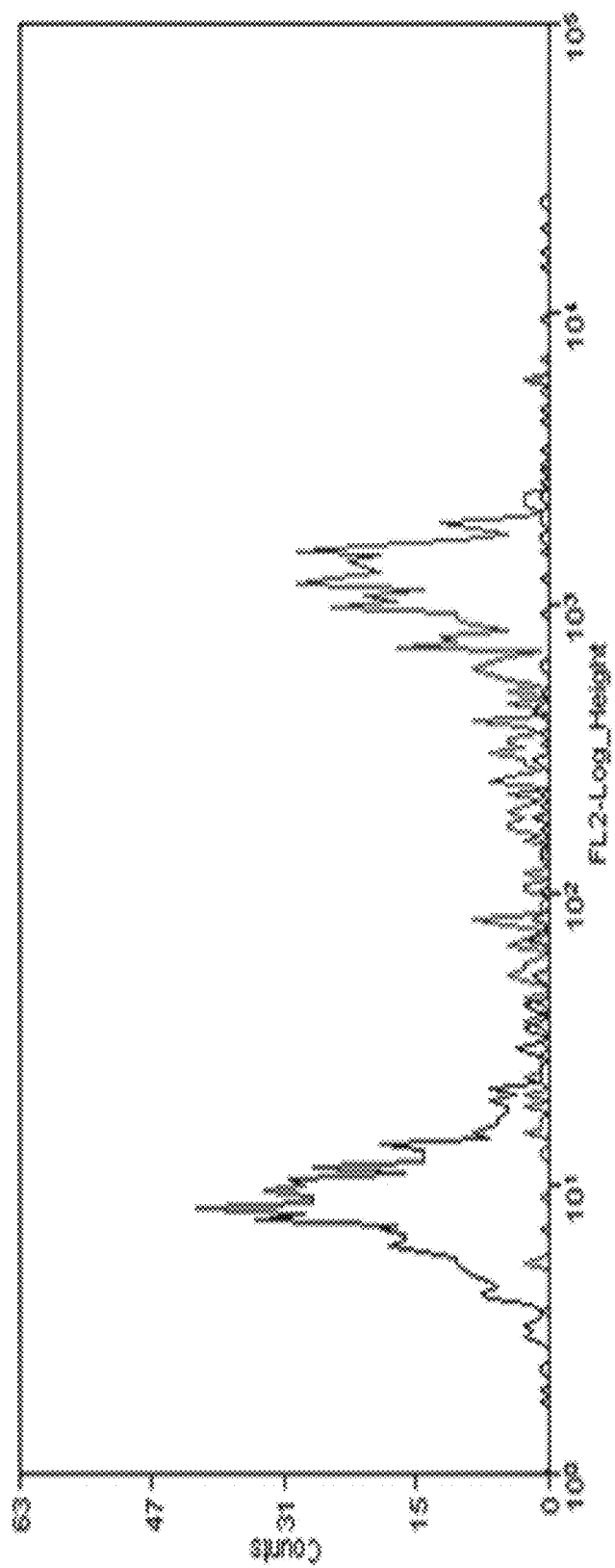
FIGS. 10I-10J illustrate capture of VCaP EVs (40 mg/mL) by lipid moiety on LumAvidin microspheres and detected with anti-CD9-PE and anti-CD63-PE by MoFlo (FIG. 10I) or with anti-CD9-PE by Luminex (FIG. 10J).

Following this protocol, VCaP microvesicles were captured by the biotinylated lipid moiety [1,2-dihexadecanoyl-sn-glycero-3-phosphoethanolamine-N-(cap biotinyl)] bound to magnetic streptavidin beads. When these microvesicles were stained with PE-labeled antibodies against the tetraspanins CD9 and CD63, the MFI of the PE signal detected by MoFlo titrated along with the input amount of VCaP microvesicles. Furthermore, the beads were saturated with microvesicles at the highest concentrations of VCaP input. See FIGS. 10C-10F for results demonstrating enrichment of bead-conjugated microvesicles in the presence of the lipid anchor. The signal derived from the lipid-anchored vesicles was correlated to the amount of vesicles, as shown in FIG. 10G and FIG. 10H.

Figure 10J:
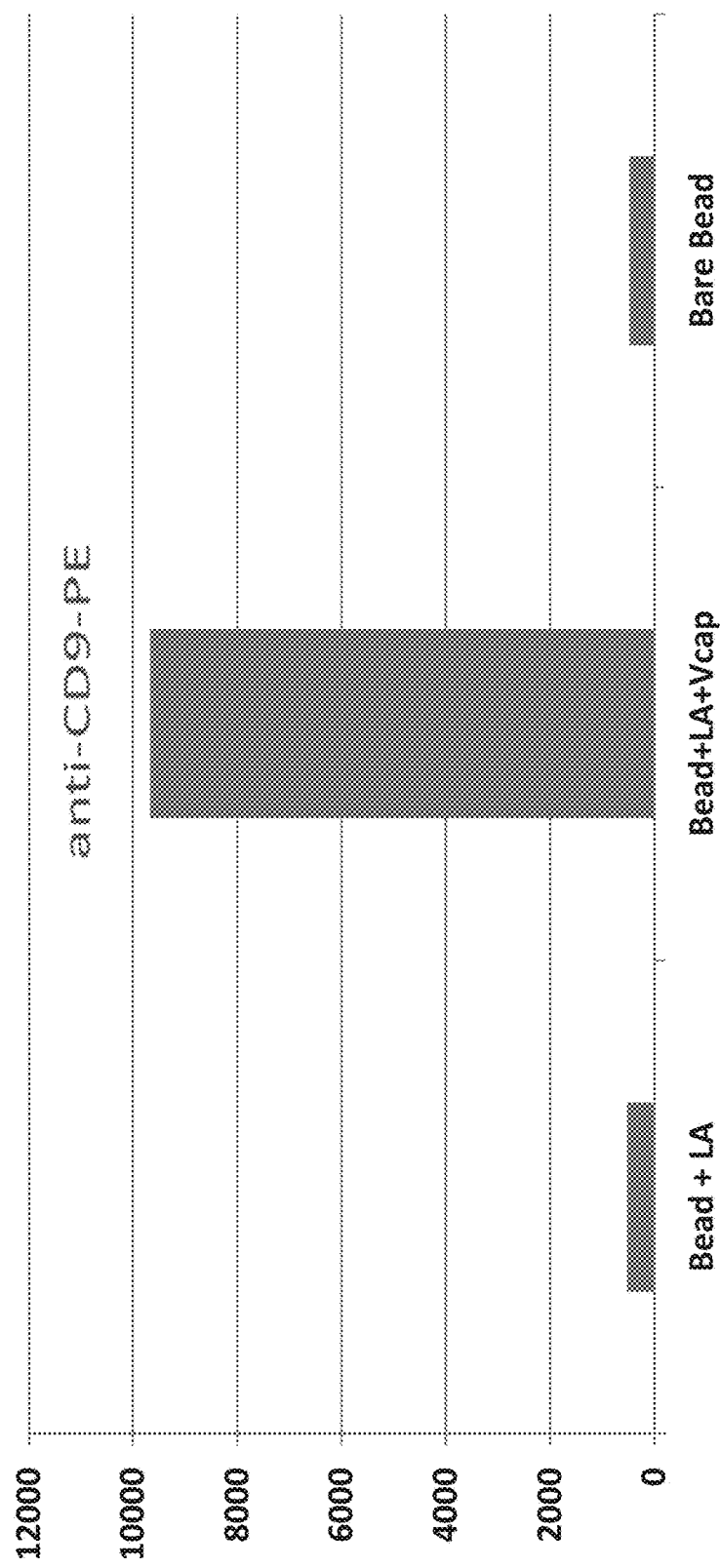

The biotinylated lipid moiety was also bound to LumAvidin beads and used to capture VCaP microvesicles, which could then be analyzed by using either traditional flow cytometry (FIG. 10I) or Luminex (FIG. 10J). Tetraspanin signal was only detected in samples containing beads bound with the lipid moiety and incubated with microvesicles; control samples containing no microvesicles or in which beads were not bound to the lipid moiety were negative for anti-CD9 signal.

Lectin Binding:

Lectins are carbohydrate-binding protein. Various lectins can be used to bind sugar moieties on the surface of microvesicles. For example, concanavalin A (ConA) is a lectin that binds specifically to certain structures found in various sugars, glycoproteins, and glycolipids, mainly internal and nonreducing terminal α-D-mannosyl and α-D-glucosyl groups. Streptavidin coated beads are incubated with biotin functionalized ConA, washed and incubated with the desired microvesicles.

Microsphere conjugated microvesicles produced by either method above can be used to screen an aptamer library as described in the Examples herein.

Effects of Sample Preparation:

Sample preparation can be optimized for the capture and/or detection of substrate-tethered microvesicles. As shown in FIG. 10K and FIG. 10L, few lipid-anchored vesicles were found when anchoring vesicles isolated from plasma samples using ultracentrifugation. Similar results were observed when the plasma-derived vesicles were isolated using ExoQuick (not shown). Moreover, similar results were also observed when using microvesicles from plasma samples directly conjugated to microspheres (not shown). Without being bound by theory, it was hypothesized that highly abundant proteins in plasma samples may interfere with the microvesicle lipid anchoring or direct substrate conjugation. To test this theory, Vcap microvesicles were detected with (FIG. 10N) or without (FIG. 10M) 30 mg/ml human serum albumin (HSA) added to the samples prior to detection. These figures show that the signal of the detected vesicles was diminished in the presence of HSA.

Various methods to improve the sample preparation of blood-derived microvesicles include depletion of highly abundant proteins (e.g., HSA/IgG/Fibrinogen), removal of blood-based lipids, plasma concentration with 150 k, 300K and 1000K MWCO filters to remove proteins and other interfering materials, and/or affinity isolation (e.g., immunoprecipitation or affinity chromatography) using binding agents against vesicle surface antigens. These approaches are then followed by vesicle isolation (e.g., ultracentrifugation, ultrafiltration, Exoquick).

Figures 10O, 10P:
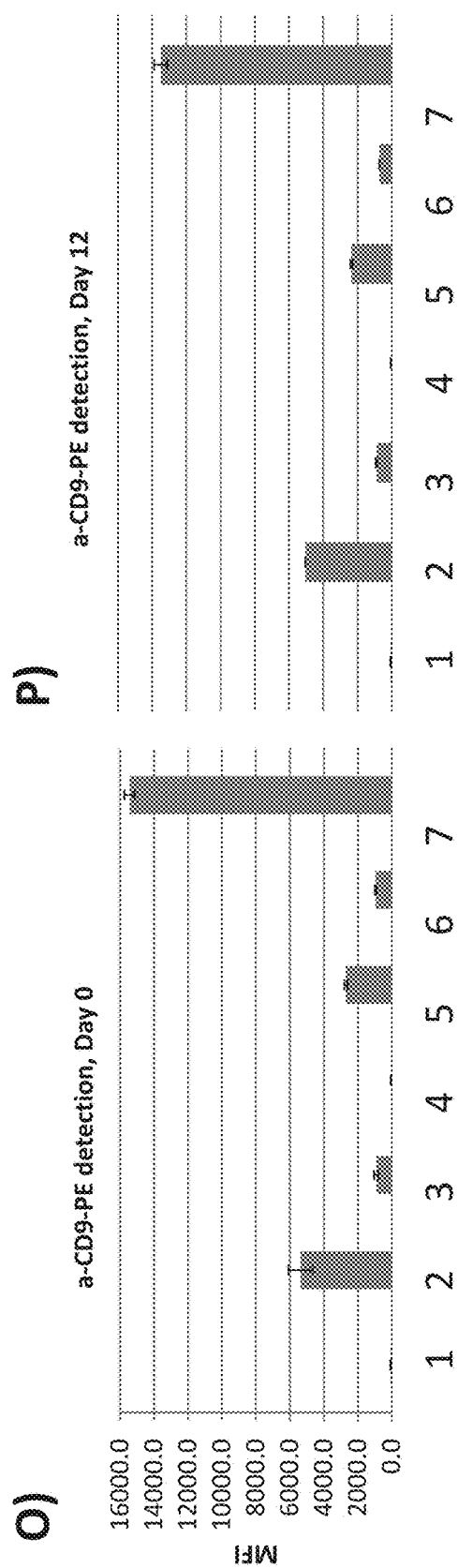

Stability:

Because the microvesicles are covalently coupled to the microbeads, there should minimal "bleeding" of conjugated microvesicles from the beads once conjugation is done and the beads are properly washed. An experiment was performed to test the stability of bead-conjugated microvesicles. Microvesicles purified using various methods were directly conjugated to microspheres as described above. The signal from the microvesicle conjugated beads were determined after storage of the conjugated beads for 2-3 days at 4° C. and again after the same beads were stored for 11-12 days at −80° C. Microvesicles were labeled with PE-conjugated anti-CD9 antibody or PE-conjugated anti-CD63 antibody. MFI values for each of the lots of beads were determined. FIGS. 10O-10P shows that minimal degradation of signal was observed before and after 12 days of storage at −80° C. using the anti-CD9 detector. Vesicles isolated using different methods were tested as indicated by conditions along the X-axis: 1) ExoQuick™ Kit (System Biosciences, Inc., Mountain View, Calif.) followed by ultrafiltration; 2) ultracentrifugation; 3) ultracentrifugation followed by Exoquick; 4) ExoQuick to ExoMir™ Kit (Bioo Scientific Corp., Austin Tex.); 5) ultrafiltered VCAP vesicle prep #1; 6) ultrafiltered VCAP vesicle prep #2; and 7) ultrafiltration followed by ultracentrifugation. Identical results were observed with the anti-CD63 detector.

Figure 11A:
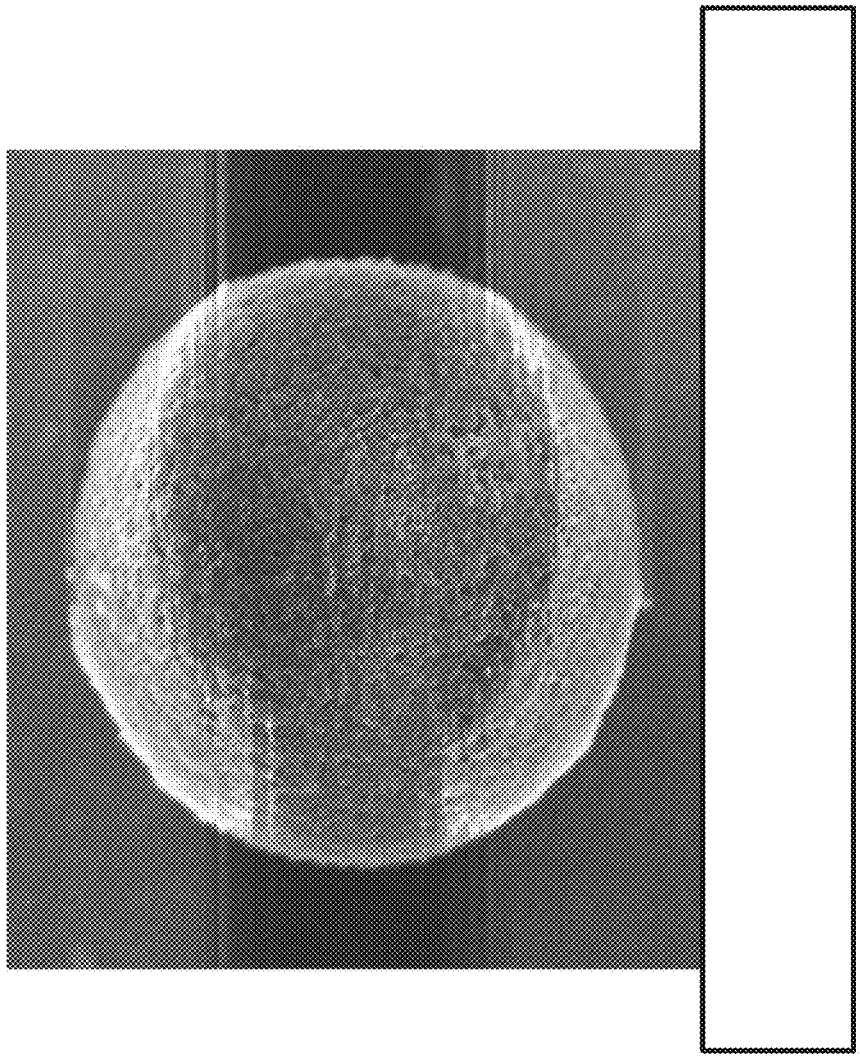
Figure 12A:
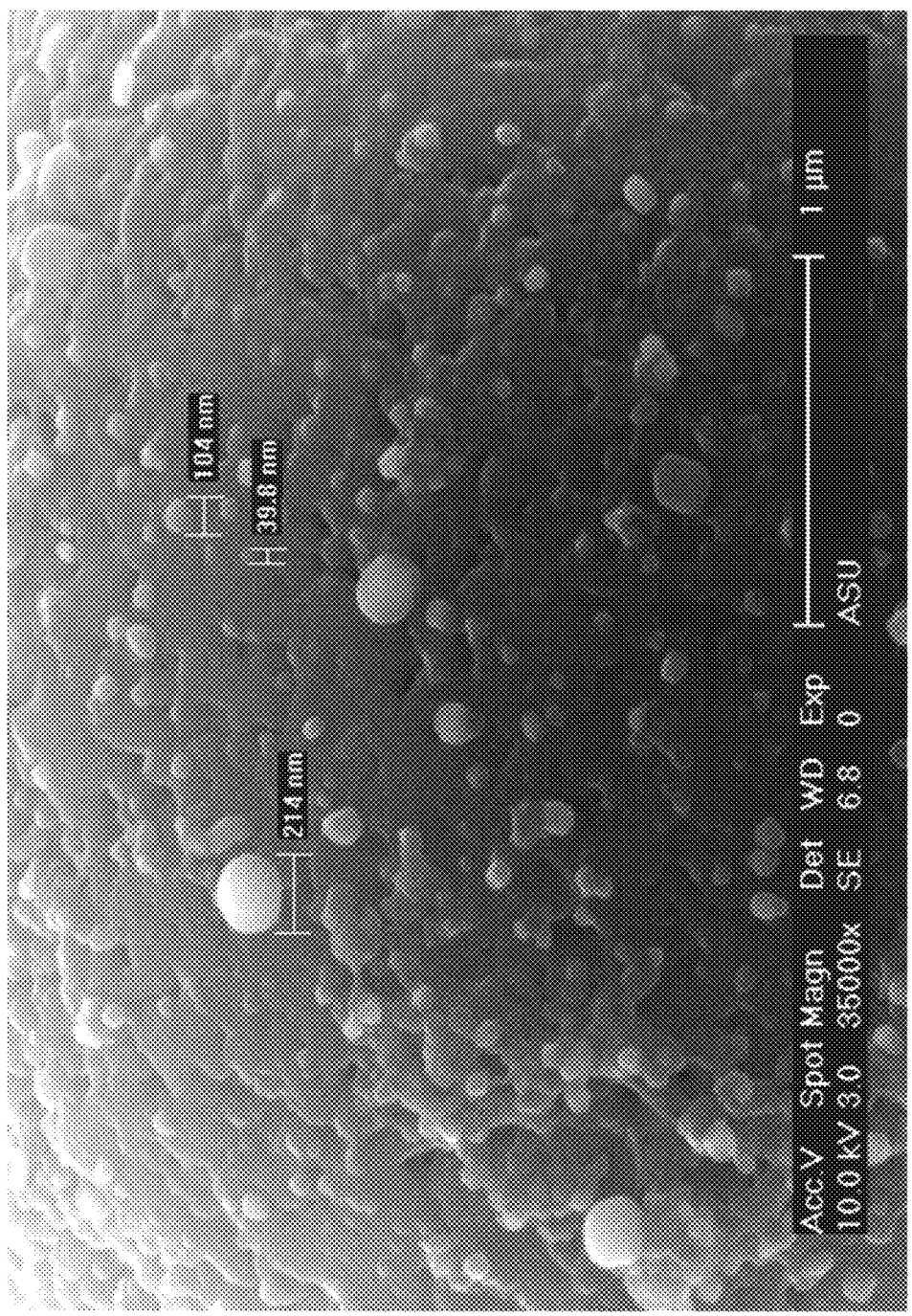
FIGS. 12A-12E illustrate FE-SEM-ImmunoGold protocol for imaging microvesicles conjugated to microbeads. The images shows secondary electron imaging (SE) and Back Scattered Electrons (BSE) images of carboxylated beads conjugated with microvesicles.
Figure 12B:
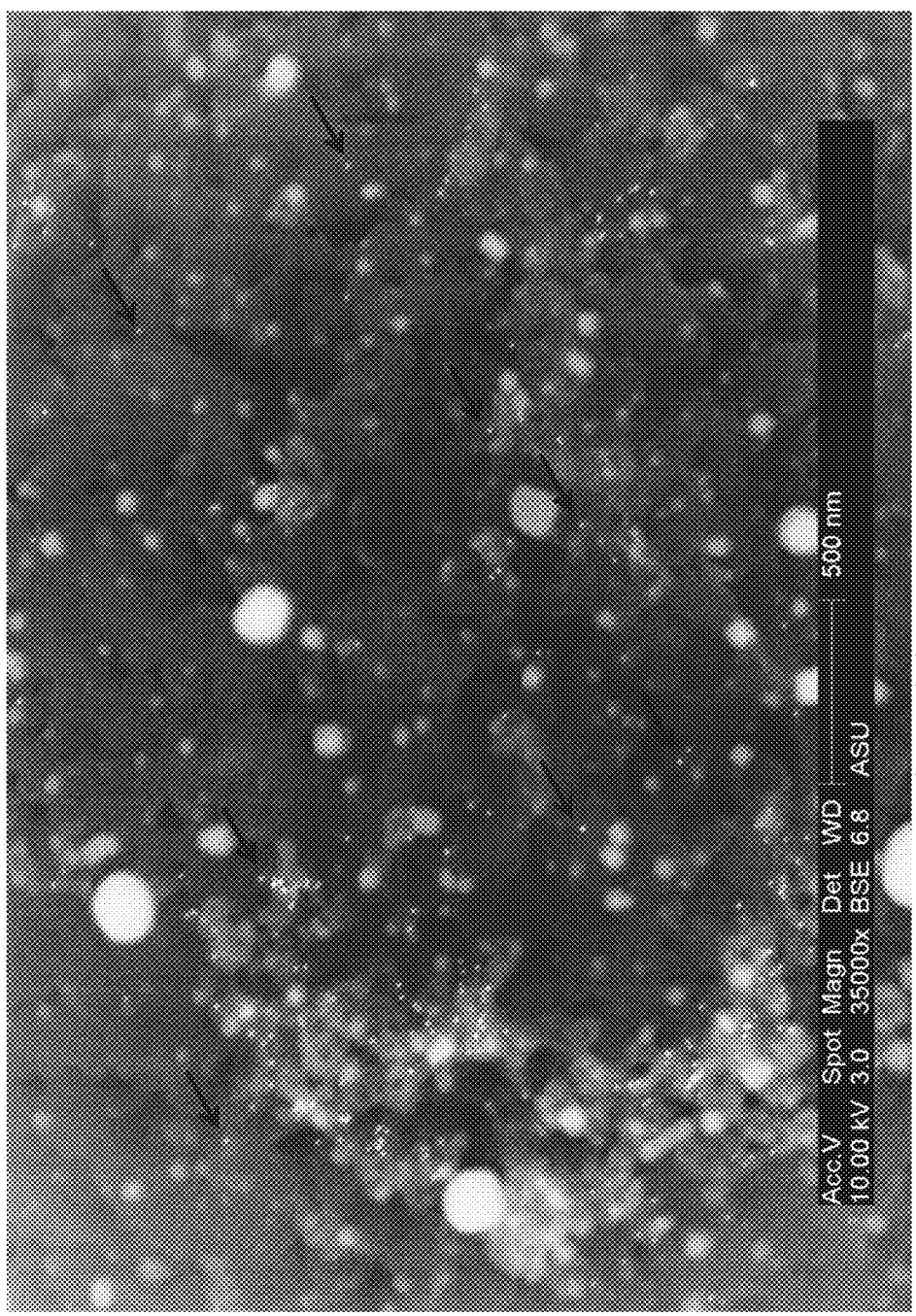
Figure 12C:
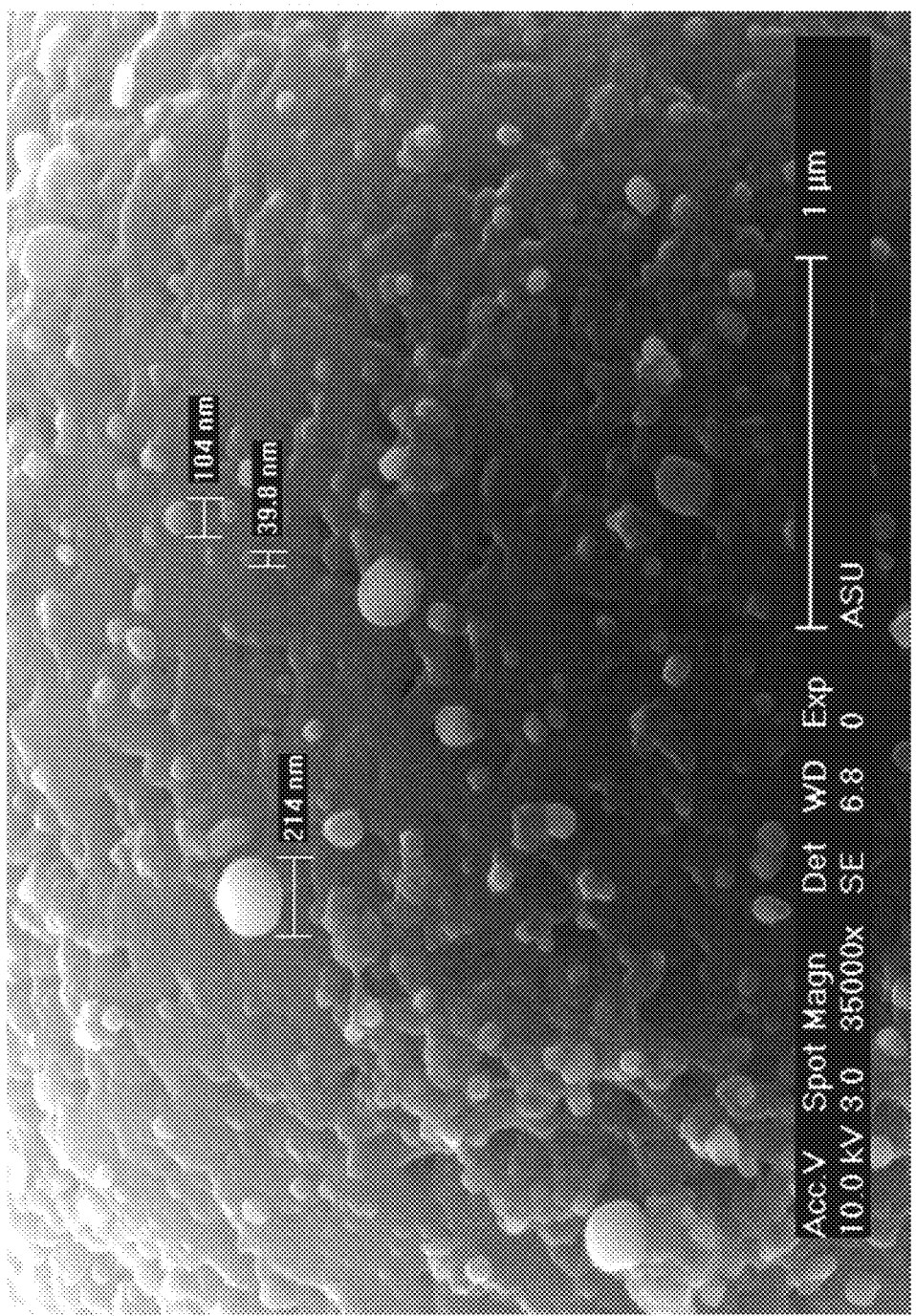
Figure 12D:
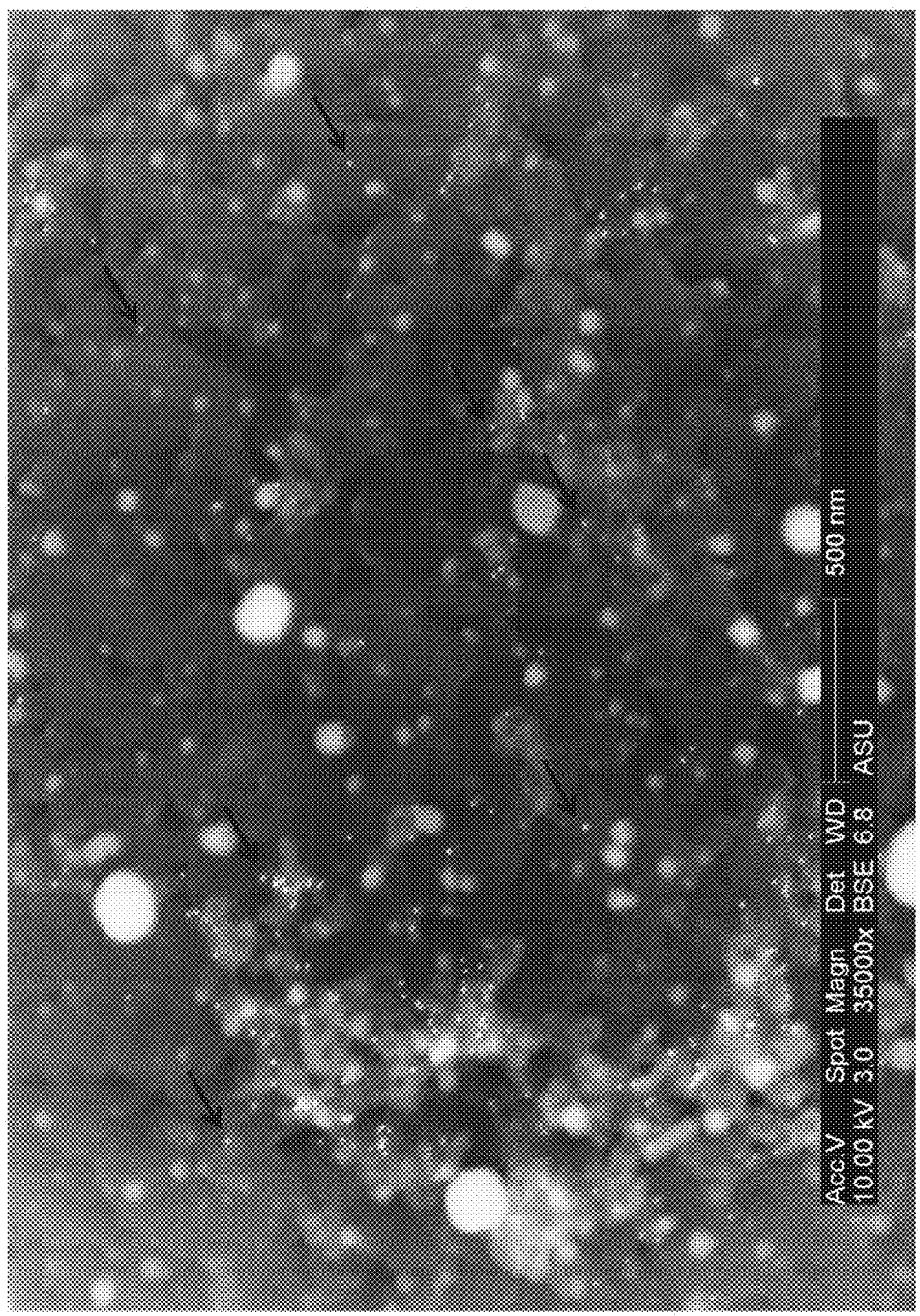
Figure 12E:
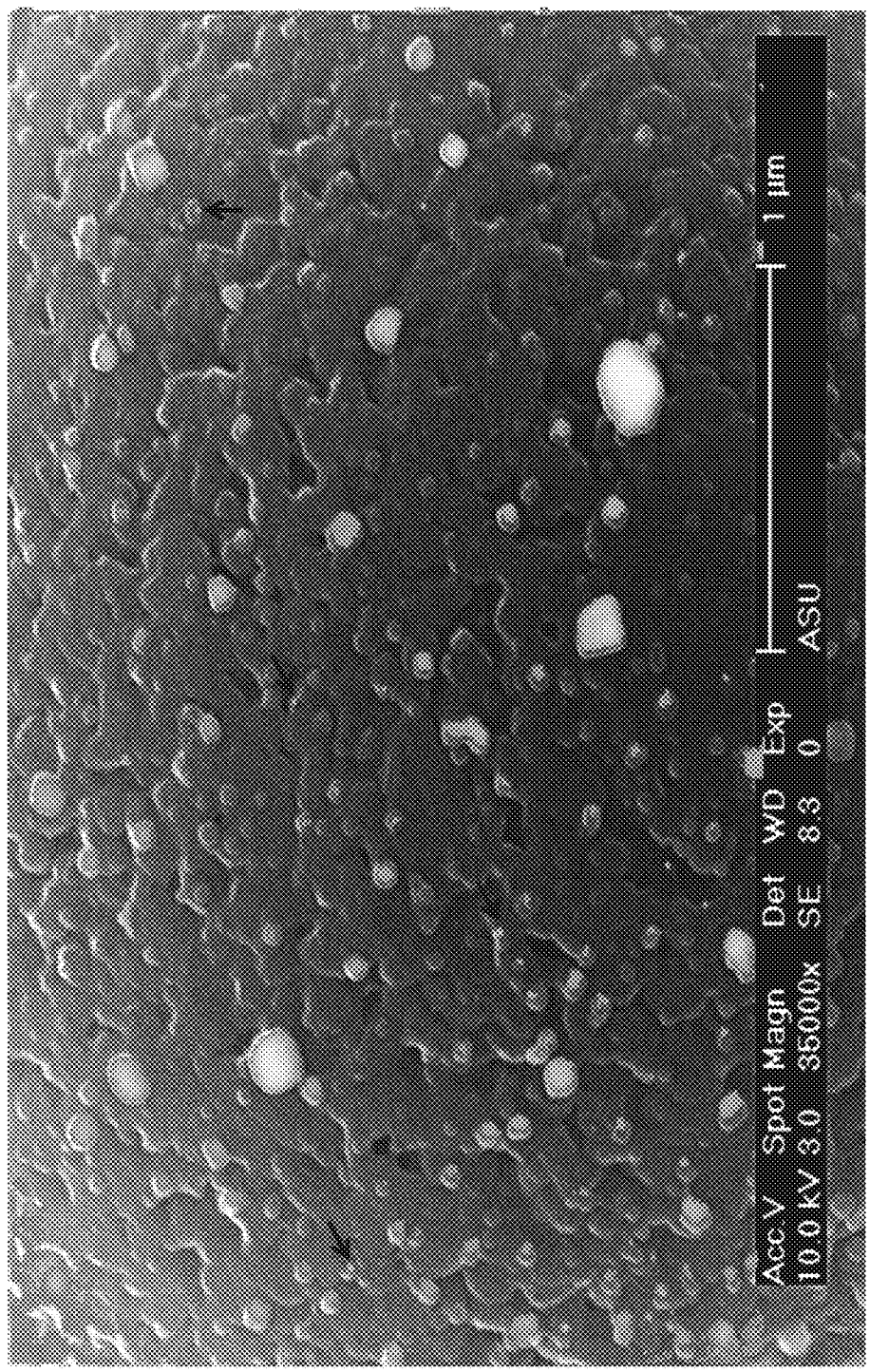

Imaging of Tethered Microvesicles:

Field emission scanning electron microscopy (FE-SEM) was used for evaluation of the alternative protocols for tethering microvesicles isolated from plasma to the surface of microspheres. FIGS. 11A-11N show the FE-SEM images. FIG. 11A shows a microsphere that has not been functionalized or conjugated. FIG. 11B shows direct conjugation of plasma microvesicles isolated using ultracentrifugation to non-magnetic beads. FIG. 11C shows a blow up of the indicated region of FIG. 11B. The arrows point to various microvesicles. FIG. 11D and FIG. 11E correspond to FIG. 11B and FIG. 11C, respectively, except that the beads are magnetic. FIGS. 11F-H show functionalized magnetic beads. FIG. 11F shows avidin conjugated beads functionalized with biotinylated ConA. FIG. 11G shows avidin conjugated beads functionalized with a biotinylated lipid anchor. FIG. 11H shows beads directly conjugated with anti-CD9 antibodies. FIG. 11I shows bead capture of plasma microvesicles isolated using ultracentrifugation to ConA functionalized beads. FIG. 11J shows a blow up of the indicated region of FIG. 11I. The arrows point to various microvesicles. FIG. 11K shows bead capture of plasma microvesicles isolated using ultracentrifugation to lipid anchor functionalized beads. FIG. 11L shows a blow up of the indicated region of FIG. 11K. The arrows point to various microvesicles. FIG. 11M shows bead capture of plasma microvesicles isolated using ultracentrifugation to lipid anchor functionalized beads. FIG. 11N shows a blow up of the indicated region of FIG. 11M. The arrows point to various microvesicles.

Summary:

All three platforms for tethering of vesicles to the microspheres (direct conjugation, antibody binding, and lipid anchor) were demonstrated using Vcap (human prostate cell line) derived microvesicles. With optimized sample conditions (e.g., removal of highly abundant proteins), similar results are observed using vesicles isolated from human plasma samples. It is surprising to obtain sufficient coupling of a complex microvesicle structure directly to beads given the potential for interference of molecular entities, including but not limited to steric interference via different sized vesicles, aggregate formation, soluble protein blocking, or vesicle fragment interference. Microsphere attached microvesicles produced by the methods in this Example can be used to screen an aptamer library as described in the Examples above.

Example 29: Protocol for Two-Step Carbodiimide Coupling of Protein or Microvesicles to Carboxylated Microspheres The protocol below is used to conjugate proteins (e.g., antibodies) or microvesicles to carboxylated microspheres (MagPlex® magnetic microspheres or MicroPlex® non-magnetic microspheres, Luminex Corporation, Austin, Tex.).

Materials:
Region 15: Luminex Catalog # MC10015-01 Lot # B28049 Exp: 2016/12/16
Region 18: Luminex Catalog # MC10018-01 Lot # B29449 Exp: 2017/3/14

Protocol:
Microspheres should be protected from prolonged exposure to light throughout this procedure.

1. Resuspend the stock uncoupled microsphere suspension according to the instructions described in the Product Information Sheet provided with the microspheres.
2. Transfer $5.0 \times 10^6$ of the stock microspheres to a USA Scientific microcentrifuge tube. Ratio Protein/Beads: 20 μg/$5 \times 10^6$. Can be scaled down to 4 μg/$10^6$.
3. Place the tube into a magnetic separator and allow separation to occur for 60 seconds. See Technical Note 1 below.
4. With the tube still positioned in the magnetic separator, remove the supernatant. Take care not to disturb the microspheres.
5. Remove the tube from the magnetic separator and resuspend the microspheres in 100 μL dH2O by vortex and sonication for approximately 20 seconds.
6. Place the tube into a magnetic separator and allow separation to occur for 60 seconds.
7. With the tube still positioned in the magnetic separator, remove the supernatant. Take care not to disturb the microspheres.
8. Remove the tube from the magnetic separator and resuspend the washed microspheres in 80 μL 100 mM Monobasic Sodium Phosphate, pH 6.2 by vortex and sonication for approximately 20 seconds.
9. Add 10 μL of 50 mg/mL Sulfo-NHS (diluted in dH20) to the microspheres and mix gently by vortex.
10. Add 10 μL of 50 mg/mL EDC (diluted in dH20) to the microspheres and mix gently by vortex.
11. Incubate for 20 minutes at room temperature with gentle mixing by vortex at 10 minute intervals.
12. Place the tube into a magnetic separator and allow separation to occur for 60 seconds.
13. With the tube still positioned in the magnetic separator, remove the supernatant. Take care not to disturb the microspheres.
14. Remove the tube from the magnetic separator and resuspend the microspheres in 250 μL of 50 mM MES, pH 5.0 by vortex and sonication for approximately 20 seconds. See Technical Note 2 below.
15. Repeat steps 12 and 13. This is a total of two washes with 50 mM MES, pH 5.0.
16. Remove the tube from the magnetic separator and resuspend the activated and washed microspheres in 100 μL of 50 mM MES, pH 5.0 by vortex and sonication for approximately 20 seconds.
17. Add 20 μg protein or equivalent microvesicles to the resuspended microspheres.
18. Bring total volume to 500 μL with 50 mM MES, pH 5.0. Note: This volume can be scaled down in case of $10^6$ beads conjugation.
19. Mix coupling reaction by vortex.
20. Incubate for 2 hours with mixing (800 rpm on MixMate) at room temperature.
21. Place the tube into a magnetic separator and allow separation to occur 60 seconds.
22. With the tube still positioned in the magnetic separator, remove the supernatant. Take care not to disturb the microspheres.
23. Remove the tube from the magnetic separator and resuspend the coupled microspheres in 500 μL of PBS-T by vortex and sonication for approximately 20 seconds. See Technical Note 3 below.
24. Incubate for 30 minutes with mixing (by rotation) at room temperature. Performed this step as I used the microspheres same day.
25. Place the tube into a magnetic separator and allow separation to occur for 30 to 60 seconds.
26. With the tube still positioned in the magnetic separator, remove the supernatant. Take care not to disturb the microspheres.
27. Remove the tube from the magnetic separator and resuspend the microspheres in 1 mL of PBS-TBN by vortex and sonication for approximately 20 seconds. See Technical Note 4.
28. Repeat steps 25 and 26. This is a total of two washes with 1 mL PBS-TBN.

29. Remove the tube from the magnetic separator and resuspend the coupled and washed microspheres in 250 ul PBS-TBN (150 ul for 1 million beads in PBS-TBN).
30. Count the microsphere suspension by vicell Technical Note 1: For a list of magnetic separators, see bead manufacturer recommendations. Optimal separation time may vary with the type of separator used.

Technical Note 2: Coupling can be performed in 100 mM MES, pH 6.0 with similar results. In some cases, better solubility and better coupling may be achieved at a higher coupling pH or in a different buffer. If the target does not couple satisfactorily under these recommendations, try PBS, pH 7.4 as an alternate coupling buffer.

Technical Note 3: Either PBS-TBN (PBS, 0.1% BSA, 0.02% Tween-20, 0.05% Azide, pH 7.4) or PBS-BN (PBS, 1% BSA, 0.05% Azide, pH 7.4) may be used as Blocking/Storage Buffer.

Technical Note 4: Either PBS-TBN or PBS, 0.05% Tween-20 may be used as Wash Buffer.

Example 30: Microsphere Conjugated Microvesicles as a Platform for Identifying Cancer Specific Aptamers Strategies for partitioning of aptamer libraries include: (i) solid support fixed target (e.g., agarose, polymethyl methacrylate, or paramagnetic beads); (ii) gel mobility shift; (iii) nitrocellulose membrane which binds proteins but not DNA; and (iv) capillary electrophoresis. In order to develop an aptamer for a cancer specific protein, each of these approaches typically starts with recombinant protein already known to be associated (to at least some extent) with the cancer secured on solid support in a way which allows partitioning of aptamer pool into "binder" and "non-binder" populations. These approaches further assume that: (i) the recombinant protein folding will reflect the natural protein in situ (e.g., in a tissue or a bodily fluid such as blood), although chemical immobilization of protein may modify its structure and conformation; and (ii) there is no interaction with other components in the desired biological sample. Accordingly, identifying and developing aptamers to detect cancer using samples from patients with confirmed cancer as well as from healthy individuals remains a challenge. This Example describes one such approach that allows for selection of aptamers that differentiate cancer without prior knowledge of the aptamer target and wherein the targets are found in their native environment/conformation.

Intact microvesicles—instead of individual proteins—isolated from patient samples are conjugated directly to microspheres. Carboxylated beads are useful to immobilize microvesicles via primary amino groups of microvesicle surface proteins. Alternately, microvesicles can be immobilized via lipid anchoring. See Examples 28 above. Labeled microspheres allow conjugation and aptamer library enrichment to be confirmed directly in a single assay. Magnetic beads can provide additional convenience for handling.

Although microvesicles can be bound to microvesicles via non-covalent bonding (e.g., antibody or aptamer binding, adsorption), such binding typically has insufficient stability to allow efficient aptamer screening.

The aptamer development process is performed following these steps:

1) Isolate microvesicles from cancer and normal patient blood samples (plasma or serum). The samples are depleted of highly abundant proteins (e.g., IgG, human serum albumin (HSA)) prior to vesicle isolation.

2) Conjugate the isolated microvesicles to carboxylated beads using standard two-step carbodiimide chemistry as known in the art. Alternately, the microvesicles are conjugated via lipid anchoring.

3) Incubate the vesicle conjugated beads with an aptamer library in parallel for cancer and normal samples. The aptamer library is pre-incubated with assay components (e.g., beads and plasma coated beads) to remove any aptamers that bind such components.

4) Discard the supernatant containing unbound aptamers. Wash the vesicle conjugated beads ~10 times using phosphate buffered saline (PBS) with 0.1% Tween 20.

5) Disassociate aptamers bound to microvesicles by treatment with NaOH, neutralize the solution, precipitate aptamers and amplify the recovered aptamers using qPCR. The recovered qPCR products are used as the starting library for the next round of selection (i.e., to repeat the process starting at step 3).

6) Once the aptamer library complexity is decreased at least down to $10^6$ members (starting from, e.g., $10^{15}$), the aptamers are sequenced using high throughput next generation sequencing technology (Illumina MiSeq® System, Illumina, Inc., San Diego, Calif.). After sequencing cancer and normal specifically enriched aptamer pools in parallel, sequences overlapping in both the cancer and normal pools are discarded and those sequences specific for a majority of cancer samples are considered as aptamer candidates.

Example 31: Microvesicle Aptamer Selection Method

This Example presents a method of selecting aptamers that can be used to differentiate microvesicles from cancer patients and control samples without cancer (e.g., "normals"). The cancer can be chosen as a particular lineage of cancer. The controls can be divided into various pathology groups (e.g., positive for conditions other than the chosen cancer) to provide an additional layer of complexity. The method enriches an aptamer library for aptamer members that bind to cancer-derived microvesicles but not the control microvesicles.

In the scheme, "positive selection" refers to enrichment aptamers to cancer-derived microvesicles, whereas "negative selection" refers to depletion of aptamers that bind control microvesicles. Generally, the scheme alternates between positive and negative selection, such that negative selections is performed in between every positive selection. The selections are performed against bead-conjugated microvesicles as described above.

A cohort 250 plasma samples are obtained. Approximately one-third of the samples are from cancer patients and the rest are controls. The samples are pooled into pools of 5-6 samples, resulting in ~16 cancer pools. Microvesicles from the pooled samples are conjugated to microbeads using methods described above.

Positive selection is first performed for each pool. Next negative selection is performed. Seven positive/negative selections are performed in parallel. In each parallel selection, the pools are randomly ordered to avoid selection bias. See FIG. 13B for graphical depiction. After each round, the remaining aptamer pools are sequenced using Next-generation sequencing technology. The sequencing can identify any enrichment in the positive rounds and/or depletion in the negative rounds. Any consensus sequences (sequence and/or structure) are also identified after each round. If identified consensus sequences are lost after certain rounds in a minority of pools but not others, those pools can be analyzed to determine if any error has been introduced.

Example 32: ImmunoGold Labeling of Microvesicles Conjugated or Immunoprecipitated on Microspheres As described herein, standard methods for detection and characterization of microvesicles include Western blot, Dynamic Light Scattering, flow cytometry, and electron microscopy. As described above, microvesicles can be captured by antibody conjugated to microbeads and detected with another labeled antibody in a flow-based microbead assay. See Example 28. Electron microscopy can be used to confirm the presence of microvesicles captured on the beads in this immunoassay. This Example provides electron microscopy with ImmunoGold labeling to image microvesicles conjugated or immunoprecipitated on microspheres.

General Considerations:

Microvesicles were isolated by ultracentrifugation from human plasma and conjugated to non-magnetic carboxylated microspheres (MicroPlex® Microspheres, Luminex Corporation, Austin Tex.). After conjugation, beads are labeled with murine anti-CD9 monoclonal antibody followed by anti-mouse-ImmunoGold (10 nm particles), mounted on poly-Lysine coated cover slip, dried, dehydrated, critical-point dried, carbon coated and imaged using Scanning Electron Microscopy with (a) Secondary Electrons (SE) mode—to visualize microvesicles and (b) Back Scattered Electrons (BSE) mode—to visualize the gold nanoparticles.

Steps involved include: (i) labeling microvesicles on beads with membrane protein specific antibody and corresponding anti-species Gold conjugate; (ii) regular sample preparation steps for scanning electron microscopy (SEM); (iii) carbon sputter coating (in place of Gold-Palladium); (iv) combination of SE and BSE imaging.

Conjugation of microvesicles to the beads can be replaced with immunoprecipitation of microvesicle to the beads, e.g., using beads conjugated to an antibody against a microvesicle surface antigen.

Protocol:

Starting material comprises microvesicle sample directly conjugated to MicroPlex beads. See Example 28 for general methodology.

1. Centrifuge 4 µl aliquot of starting material (in 1.5 ml microcentrifuge tube) for 1 min at 13,000 rpm to pellet beads. Remove supernatant without disturbing the pellet.

2. Add 20 µl of blocking buffer PBS-BSAT (phosphate buffered saline with bovine serum albumin and Tween®-20: (0.1M NaPO4 pH 7.2/150 mM NaCl/1% BSA/0.01% T20)) and resuspend the pellet. Incubate for 30 min at room temperature.

3. Centrifuge for 1 min at 13,000 rpm to pellet beads. Remove supernatant.

4. Add 20 µl of primary antibody solution (10 or 100 µg/ml, mouse monoclonal anti-CD9 antibody (BD Biosciences Catalog No. 555370, Lot 2097575) with PBS-BSAT) and resuspend the pellet.

Incubate for 30 min at room temperature.

5. Wash 3 times with 50 µl PBS-BSAT (pellet by centrifuge 1 min at 13,000 rpm, remove supernatant) for 5 min at room temperature.

6. Add 20 µl of secondary antibody solution (at 1:100, 0.3 µg/ml, anti-mouse-gold (goat anti-mouse-Gold antibody, 10 nm, MP Biomedicals Catalog No. #67854) with PBS-BSAT) and resuspend the pellet. Incubate for 20 min at room temperature.

7. Wash 3 times with 50 µl PBS (lx, HyClone, pH 7.4) for 5 min at room temperature.

8. After removing supernatant, add 10 µl of PBS and resuspend the pellet.

9. Take 2 µl of labeled and resuspended beads to a poly-L-lysine precoated coverslip and smear gently to spread beads on surface 10. Incubate the cover slip in a humidified chamber for 10 min, covered at room temperature.

11. Primary fixing with 3 ml of 2% Glutaldehyde with 1×PBS, in individual disposal Petri dish, covered, for 30 min at room temperature. Work in safety hood.

12. Wash coverslip 3 times with 1×PBS. Dispose primary fixing solution and washes in designated hazardous waste container.

13. Secondary fixing with 0.5% Osmium tetraxide in 1×PBS, covered for 30 min at room temperature in safety hood.

14. Wash coverslip 3 times with nanopure water. Dispose secondary fixing solution and washes in designated hazardous waste container.

15. Dehydrate coverslip in series of ethanol, place coverslip in stainless steel mesh basket, 5 min each at room temperature: 1) 20% ethanol; 2) 50% ethanol; 3) 75% ethanol; 4) 100% ethanol; 5) repeat 100% ethanol twice more.

16. Critical-point dried (CPD) in liquid carbon dioxide.

17. Mount coverslip on aluminum stage with adhesive

18. Carbon sputter coating

19. Obtain images using SE (focusing) and BSE (detecting gold).

Results:

Imaging of bead-conjugated microvesicles according to the protocol above is shown in FIGS. 12A-12E.

REFERENCES

S. L. Erlandsen, P. T. Macechko and C. Frethem. High resolution backscatter electron (bse) imaging of immunogold with in-lens and below-the-lens field emission scanning electron microscopes. Scanning Microscopy 13:43-54 (1999).

Example 33: Competitive Isolation of Aptamers to Microvesicles

The method of Example 31 is performed to identify aptamers that bind microvesicle antigens of interest. Anti-tetraspanin antibodies are tethered to microbeads and incubated with cMVs from plasma samples from prostate cancer patient. The captured cMVs serve as the analyte in the method of Example 31. Aptamer candidates are disassociated from the microvesicle using the antibodies in Table 26.

TABLE 26

Antibodies

| Target | Vendor | Catalog# | Lot# |
|---|---|---|---|
| 14-3-3 zeta/beta | Novus Biologicals | NB100-1964 | 2230612 |
| Aconitase 2 | Novus Biologicals | NBP2-02241 | A01 |
| ADAM 9 | Novus Biologicals | H00008754-M01 | D2041-3E6 |
| ADAM10 | R&D systems | MAB1427 | HZR0311111 |
| ADE2 | Novus Biologicals | NBP2-02817 | A01 |
| AFM | Creative Diagnostics | CAB-1089MH | PR78801Z |
| Ago2 | | | |
| AGR2 | Novus Biologicals | H00010551-M01 | 11042-1E5 |
| AKT1 | Neuoromics | MO15107 | 401484 |
| ALDH1A3 | Origene | CF502841 | A003 |
| ALDH6A1 | LifeSpan Biosciences | LS-C156268 | 45269 |
| ALDOA | Novus Biologicals | H00000226-M03 | 08123-2E6, 11097-2E6 |
| ALIX | Thermo scientific | MA1-83977 | NL1643884, NL1640867 |
| ANGPTL4 | Novus Biologicals | H00051129-M01 | D3151-1F7 |
| ANXA1 | Millipore | MAB3773 | 2148887 |
| ANXA2 | Millipore | MAB3774 | 2148886, 2140018 |
| ANXA3 | Novus Biologicals | H00000306-M12 | 11258-4F1 |
| ANXA3 | Novus Biologicals | H00000306-M12 | D5231-4F1 |
| ANXA4 | LIFESPAN BIOSCIENCES | LS-B4279 | 32117 |
| AP1G1 | LIFESPAN BIOSCIENCES | LS-C171339 | 45239 |
| APAF1 | Lifespan Biosciences Inc. | LS-C3755 | 44521 |
| APE1 | Novus | NB100-116PUR | 32813 |
| APLP2 | Novus Biologicals | H00000334-M04 | 11326-4B5 |
| APLP2 | Novus Biologicals | H00000334-M04 | 06363-4B5, 11326-4B5 |
| ARF6 | LIFESPAN BIOSCIENCES | LS-C87646 | 44235, 44199 |
| Aspartyl Aminopeptidase/Dnpep | Novus Biologicals | H00023549-M01 | 08263-s3 |
| Ataxin 1 | Novus Biologicals | H00006310-M02 | D4291-4C5, D5071-4C5 |
| ATP5A1 | Proteintech | 66037-1-Ig | 10000914-barcode number |
| ATPase Na+/K+ alpha 3/ATP1A3 | Novus Biologicals | NB300-540 | NJ175778 |
| ATPase Na+/K+ beta 3/ATP1B3 | Novus Biologicals | H00000483-M03 | 6125-1E9-011b4by6 |
| ATPase Na+/K+ beta 3/ATP1B3 | Novus Biologicals | H00000483-M03 | D5311-1E9 |
| ATPB | Novus Biologicals | NB600-1171 | MJ163306 |
| AZGP1 | BD | 612354 | 80749, 3086574, 3121936 |
| B4GALT1 | Sino Biological | 11220-MM01 | HB06JL0607 |
| B7H3 | R&D systems | MAB1027 | HPA0411031 |
| BCHE | Lifespan biosciences | LS-C35215-100 | 42885 |
| BclG | Novus Biologicals | H00079370-M01 | 12108-1F2 |
| BDKRB2 | Novus Biologicals | H00000624-M01 | 11209-3F6 |
| BDNF | R&D systems | MAB848 | BBL1512091 |
| BDNF | R&D systems | MAB848 | BBL1211091 |
| beta 2 Microglobulin | Novus Biologicals | NB500-317 | 515273 |
| beta catenin | Novus Biologicals | H00001499-M02 | D2011-1C9 |
| BRG1 | Millipore | MABE60 | NRG1782322, 2207807 |
| CALM2 | Novus Biologicals | H00000805-M01 | D5311-S2 |
| Calmodulin 2/CALM2 | Novus Biologicals | H00000805-M01 | 10337-S2 |
| Calnexin | Novus Biologicals | H00000821-M08 | 11132-1D4, 08179-1D4 |
| Calpain 1 | LIFESPAN BIOSCIENCES | LS-B4768 | 45956 |
| Catenin Alpha 1 | Novus Biologicals | NB100-74356 | OB183849 |
| CAV1 | Novus Biologicals | NBP1-74036 | A1120901 |
| CCR2/CD192 | Novus Biologicals | NB120-10396 | 061M1621 |
| CCR5 | Novus Biologicals | NBP1-43335 | E022691 |
| CCT2 (TCP1-beta) | Novus Biologicals | H00010576-M01 | 12108-2G6 |
| CD10 | BD Pharmingen | 555373 | 32631 |
| CD151 | R&D systems | MAB1884 | JFU0210121 |
| CD166/ALCAM | R&D Systems | MAB6561 | DXM0312051 |
| CD24 | BD Pharmingen | 555426 | 25844 |
| CD276 | Novus Biologicals | NBP2-12048 | 2013032102 |
| CD41 | Mybiosource | MBS210248 | 1003 |
| CD46 | Novus Biologicals | NB500-301 | 512525 |
| CD49d | Novus Biologicals | H00003676-M01 | 11039-2C11 |
| CD63 | BD pharmingen | 556019 | 2244712 |
| CD71/TRFR | Novus Biologicals | NB100-73092 | 709/08-TR26-E4 |
| CD81 | BD pharmingen | 555675 | 25099 |
| CD9 | Novus Biologicals | NB500-327 | 517304 |
| CD9 | Novus Biologicals | NB500-327 | 517304 |
| CD90/THY1 | Novus Biologicals | NBP1-43379 | E03908-1630 |
| CDH1 | NOVUS BIOLOGICALS | H00051343-M09 | 11139-3E12 |
| CDH2 | NOVUS BIOLOGICALS | H00001000-M06 | 1137-5E6 |

TABLE 26-continued

Antibodies

| Target | Vendor | Catalog# | Lot# |
|---|---|---|---|
| CDKN1A | Thermo scientific | MA1-19271 | OB1661535 |
| CGA | Novus Biologicals | NB100-62251 | 030311 |
| CgA | Novus Biologicals | NBP1-23022 | A1113601 |
| CHRDL2 | R&D Systems | MAB24481 | WJU015101 |
| CIB1 | Novus Biologicals | NBP1-04279 | A088401 |
| CIB1 | Novus Biologicals | NBP1-04279 | D5301-51 |
| Claudin 4/CLDN4 | Novus Biologicals | H00001364-M02 | 08092-4A11 |
| Claudin 5 | Novus Biologicals | H00007122-M01 | 11291-3d8, 10334-3d8, 7149-3d8-00bcy6 |
| CLDN3 | NOVUS BIOLOGICALS | H00001365-M09 | D5311-2F2 |
| CLDN3-Claudin3 | NOVUS BIOLOGICALS | H00001365-M09 | D1281-2F2, 11256-2F2 |
| CLDN4 | Novus Biologicals | H00001364-M02 | D5311-4A11 |
| CLDN7 | Lifespan Biosciences Inc. | LS-B2918 | 44272 |
| CNDP2 | Novus Biologicals | NBP2-01281 | A01 |
| Coatomer Subunit Delta | Novus Biologicals | NBP2-01790 | A01 |
| Cofilin 2/cfL2 | Novus Biologicals | H00001073-M03 | 11238-6G9, 10106-6G9 |
| CORO1B | Novus Biologicals | H00057175-M01 | 07345-1E7, 10236-1E7 |
| Cortactin/CTTN | Novus Biologicals | H00002017-M01 | 08312-2B5 |
| COX2/PTGS2 | Life Technologies | 358200 | 1251212A |
| COX5b | Novus Biologicals | H00001329-M03 | 12241-1E, 11088-1E8 |
| CSE1L | Lifespan biosciences | LS-C104925 | 41780 |
| CTH | Novus Biologicals | H00001491-M03 | 10292-S51, 12167-S51 |
| CTNND1/delta 1-catenin/p120-catenin | Origene | CF800968 | W001 |
| CTNND2 | Novus Biologicals | H00001501-M01 | D5071-6E11 |
| CXCR3 | R&D systems | MAB160 | AOU101121 |
| CYCS | Novus Biologicals | NB100-78345 | B152009 |
| Cystatin C | Novus Biologicals | NBP1-05763 | 10/09-cc1-13 |
| Cytochrome C | Novus Biologicals | NB100-78345 | B152009 |
| Cytokeratin 18 | Novus Biologicals | NB500-353 | L41K |
| Cytokeratin 8 | Novus Biologicals | NB500-350 | 515894 |
| Cytokeratin basic | ACRIS | AM10030PU-L | 2620 |
| DBF4B/DRF1 | Novus Biologicals | H00080174-M01 | 08361-1a7 |
| DBI* | Abcam | ab16775-100 | 374264, GR122424-1 |
| DCTN-50/DCTN2 | Novus Biologicals | H00010540-M01 | 12143-2G7, 11312-2G7 |
| DDAH1 | Novus Biologicals | H00023576-M01 | D3151-3F7 |
| DDAH1 | Novus Biologicals | H00023576-M01 | D3151-3f7 |
| DDX1 | Novus Biologicals | H00001653-M02 | 09226-4F6 |
| Destrin | Novus Biologicals | NBP2-00560 | A01 |
| DIP13B/appl2 | Novus Biologicals | H00055198-M06 | 08183-1C10 |
| DIP13B/appl2 | Novus Biologicals | H00055198-M06 | D5311-1C10 |
| DLG1 | Novus Biologicals | NBP1-48054 | 1007 |
| Dnpep | Novus Biologicals | H00023549-M01 | D5311-S3 |
| E-Cadherin | Novus | NB110-61005 | 2013022601 |
| ECH1 | Novus Biologicals | H00001891-M01 | 09198-5G8, 09020-5G8 |
| ECHS1 | Novus Biologicals | H00001892-M05 | 07355-3C6 |
| ECHS1 | Novus Biologicals | H00001892-M05 | D5311-3C6 |
| EDIL3 (del-1) | Novus Biologicals | H00010085-M01 | 11074-4C9 |
| EDN-3 | Millipore | ST1513-100UG | 11287-S1 |
| EDNRB/EDN3 | Novus Biologicals | H00001908-M01 | 11287-S1, 11053-S1 |
| EGFR | Novus Biologicals | H00001956-M02 | CA091-4H2 |
| EIF4A3 | Creative Biomart | CAB-3210MH | ML7809Z |
| ENTPD4 | Novus Biologicals | H00009583-M01 | 08141-4H7 |
| EpoR | NOVUS BIOLOGICALS | H00002057-M02 | 08088-3F6 |
| EpoR | NOVUS BIOLOGICALS | H00002057-M02 | D5311-3F6 |
| ERAB | Novus Biologicals | NBP2-02118 | A01 |
| ESD | Novus Biologicals | H00002098-M01 | 12080-1E1 |
| ESD | Novus Biologicals | H00002098-M01 | 12080-1E1 |
| ETS1 | Novus Biologicals | H00002113-M02 | 09174-2G10 |
| ETS1 | Novus Biologicals | H00002113-M02 | 09174-2G10 |
| ETS-2 | Origene | CF505365 | ? |
| EZH2 | Novus Biologicals | H00002146-M07 | D5031-1D11 |
| EZH2/KMT6 | Novus Biologicals | H00002146-M07 | 11263-1D11 |
| EZR | LIFESPAN BIOSCIENCES | LS-C88343 | 44198, 44201 |
| FABP5 | Novus Biologicals | NBP1-50810 | 10/12-F29-31 |
| FARSLA | Novus Biologicals | H00002193-M01 | D3151-2D8 |
| FASN | MYBIOSOURCE | MBS850333 | NA |
| FKBP5/FKBP51 | Novus Biologicals | NB110-96873 | 802 |
| FLNB | MyBioSource | MBS531705 | 5534 |
| FTL (light and heavy) | Novus biologicals | H00002512-M16 | 10061-X1 |
| FUS | Millipore | MABE465 | QVP1212055, VP1309301 |
| GAL3 | R&D systems | MAB11541 | CAVJ0210011 |
| gamma-catenin | Novus Biologicals | H00003728-M01 | D5271-2G9 |

TABLE 26-continued

| Antibodies | | | |
|---|---|---|---|
| Target | Vendor | Catalog# | Lot# |
| GDF15 | R&D SYSTEMS | MAB957 | UDC0512091 |
| GDI2 | Prolab Marketing PVT LTD Proteintech | 60078-1-Ig | lot1 |
| GGPS1 | Abcam | ab56579 | GR939546-1 |
| GGPS1 | Abgent | AT2196a | D5211 |
| GITRL | Novus Biologicals | H00008995-M01 | 11340-6F7, 08143-6F7 |
| GloI | NOVUS BIOLOGICALS | NBP1-19015 | A-2 |
| GLUD2 | Novus Biologicals | H00002747-M01 | CB231-3C2, 12124-3C2 |
| GM2A | Novus Biologicals | H00002760-M02 | 08246-2c8 |
| GM-CSF | Invitrogen | AHC2012 | 1188352A |
| GOLM1/GOLPH2 Mab; clone 3B10 | Novus Biologicals | H00051280-M04 | D5301-3B10 |
| GOLPH2 | Abgent | AT2239a | 12227 |
| GOLPH2 | Abgent | AT2239a | 12227 |
| GPC6 | MyBioSource | MBS601169 | no lot No. |
| GRP94 | Novus Biologicals | NB110-61640 | 811 |
| GSTP1 | NOVUS BIOLOGICALS | H00002950-M01 | 12174-S2 |
| GSTP1 | NOVUS BIOLOGICALS | H00002950-M01 | D5092-S2 |
| H3F3A | Novus Biologicals | NB120-12179 | 079K4862, 083K4870 |
| HADH/HADHSC | Novus Biologicals | H00003033-M01 | 11039-4b5 |
| HGF | R&D Systems | MAB694 | AWW0411061 |
| HIST1H3A | Creative Diagnostics | DMABT-H12861 | AB04011Z |
| Histone H4 | Novus Biologicals | NBP1-78445-50u1 | 1040711 |
| hK2/Kif2a | NOVUS BIOLOGICALS | H00003796-M01 | D2041-2D4 |
| hnRNP A1 | Novus Biologicals | NB100-672 | 101M4762 |
| hnRNP A2B1 | Novus Biologicals | NB120-6102 | 044K4766 |
| hnRNP C1 + C2 | Novus Biologicals | NB600-585 | 064K4808, 6414808 |
| hnRNP K (F45)* | Novus Biologicals | NB100-74524 | u151623 |
| hnRNP L | Novus Biologicals | NB120-6106 | 1051108 |
| hnRNP M1-M4 | Novus | NB200-314PUR | 32813 |
| HOXB13 | Novus Biologicals | H00010481-M07 | 08109-1E9 |
| Hsp10/HSPE1 | Novus Biologicals | H00003336-M01 | D3151-S1 |
| Hsp40/DNAJB1 | Novus Biologicals | NBP1-04302 | A077301 |
| Hsp60 | Novus Biologicals | NB120-5479 | 048-106, 0C186263 |
| HSP90AA1 | Lifespan biosciences | LS-C36617-50 | 21937 |
| Hsp90B | Novus Biologicals | NB110-96871 | 803 |
| HSPA1A | LIFESPAN BIOSCIENCES | LS-C59523 | 44127 |
| HSPB1 | Sigma-Aldrich | WH0003315-M4 | 08115-3G3 |
| IDH2 | Novus Biologicals | H00003418-M01 | ca0515f11, D30815f11, D2061-5f11 |
| IDH3B | Novus Biologicals | H00003420-M01 | 082003a10 |
| IDH3B | Novus Biologicals | H00003420-M01 | D5311-3A10 |
| IGFBP-2 | R&D systems | MAB6741 | EYP0211041 |
| IGFBP-3 | Lifespan biosciences | LS-C45037 | 45268 |
| IgG1 | R&D Systems | MAB002 | IX2612061 |
| IgG2A | R&D Systems | MAB003 | MV0912111 |
| IgG2B | R&D Systems | MAB004 | NZ1012041 |
| IgM | Thermo Scientific Pierce | 31778 | |
| IL1alpha | NOVUS BIOLOGICALS | H00003552-M03 | 09209-4C6 |
| IL1alpha | NOVUS BIOLOGICALS | H00003552-M03 | D5031-4C6 |
| Integrin beta 7 | Novus Biologicals | NB100-78036 | B165318 |
| IQGAP1 | NOVUS BIOLOGICALS | H00008826-M01 | 12181-2C5 |
| ITGAL | LIFESPAN BIOSCIENCES | LS-C140412-100 | 41655 |
| KLHL12/C3IP1 | Novus Biologicals | NBP2-22359 | 100803 |
| KLK1 | NOVUS BIOLOGICALS | H00003816-M01 | 11074-3G2 |
| KLK10 | NOVUS BIOLOGICALS | H00005655-M01 | D3011-1G8, 08344-1G8, 09233-1G8 |
| KLK11 | R&D Systems | MAB1595 | ITM0310091 |
| KLK12 | R&D SYSTEMS | MAB4034 | YHJ016101 |
| KLK13 | NOVUS BIOLOGICALS | H00026085-M01 | 08186-1G9 |
| KLK14 | NOVUS BIOLOGICALS | H00043847-M05 | 08284-2A7 |
| KLK15 | R&D Systems | MAB2540 | KTL025041 |
| KLK4 | NOVUS BIOLOGICALS | H00009622-M09 | 08172-2A4 |
| KLK5 | NOVUS BIOLOGICALS | H00025818-M01 | 08270-3H3 |
| KLK6 | NOVUS BIOLOGICALS | H00005653-M01 | 11067-4A10 |
| KLK7 | NOVUS BIOLOGICALS | NBP2-11753 | 20130110801 |
| KLK8 | NOVUS BIOLOGICALS | H00011202-M01 | 11109-2F11 |
| KLK9 | Lifespan biosciences | LS-C37111 | 42449 |
| Ku70 (XRCC6) | Novus Biologicals | H00002547-M01 | D4291-S1 |
| Lamin B1 | LIFESPAN BIOSCIENCES | LS-C25124 | 45298 |
| LAMP1 | Novus Biologicals | NB100-1952-100ug | 711 |

TABLE 26-continued

Antibodies

| Target | Vendor | Catalog# | Lot# |
|---|---|---|---|
| Lamp-2 | Novus Biologicals | H00003920-M01 | 11062-2G10 |
| LDH-A | NOVUS BIOLOGICALS | NBP1-74023-100u1 | A119401 |
| LGALS3BP | proteintech | 60066-2-Ig | 1 |
| LGALS8 | Abgent | AT2702a | 11125 |
| Lipoamide Dehydrogenase | Novus Biologicals | NBP2-01109 | A01 |
| LLGL2 | Novus Biologicals | H00003993-M06 | cc211-4g2 |
| LSP1 | NOVUS BIOLOGICALS | H00004046-M07 | 08179-1C4 |
| LSP1 | NOVUS BIOLOGICALS | H00004046-M07 | D5311-1C4 |
| LTBP2 | Novus Biologicals | H00004053-M01 | D4011-5D7 |
| MATR3 | Lifespan Biosciences Inc. | LC-C137527 | 44577 |
| MBD5 | Novus Biologicals | H00055777-M01 | 08179-S1 |
| MDH2 | Novus Biologicals | H00004191-M06 | D4081-2A7, 07283-2a7 |
| MDM4 | Origene | TA505712 | A001 |
| ME1 | Novus Biologicals | H00004199-M03 | 12171-3H5, 11182-3H5 |
| MKI67/Ki67 | Novus Biologicals | H00004288-M01 | 11195-7B8 |
| MMP 1 | Novus Biologicals | NBP1-28604 | H0205-R931 |
| MMP 2 | Thermo scientific | MA1-12892 | OB1661361 |
| MMP 25 | R&D SYSTEMS | MAB11421 | GTT013111 |
| MMP10 | R&D systems | MAB9103 | EWC0310041 |
| MMP-14/MT1-MMP | Novus | NB110-60993 | 2013052204 |
| MMP3 | Novus Biologicals | NB100-78555 | B114136 |
| MMP7* | milipore | MAB3315 | 1957964 |
| Mortalin | Novus Biologicals | NBP1-47800 | A01 |
| MTA1 | Novus Biologicals | H00009112-M10 | 08057-1C3, 07317-1C3 |
| nAnS | Novus Biologicals | H00054187-M01 | 09015-3G6 |
| nAnS | Novus Biologicals | H00054187-M01 | D5311-3G6 |
| Nav1.7/SCN9A | NOVUS BIOLOGICALS | H00006335-M01 | 12157-5A11 |
| NCL | Lifespan Biosciences Inc. | LC-C85348 | 35642 |
| NDRG1 | Novus Biologicals | H00010397-M03 | 12094-2D7 |
| NKX3-1 | Novus Biologicals | H00004824-M02 | 10328-1C7, 12215-1C7 |
| NONO | Novus Biologicals | NBP2-02060 | A001 |
| Notch1 | R&D systems | MAB5317 | CCGK0110031 |
| NOTCH4 | Biolegend | 349002 | B165966 |
| NRP1/CD304 | Novus Biologicals | H00008829-M05 | D2041-1B3 |
| Nucleobindin-1 | Novus Biologicals | NBP2-01446 | A01 |
| Nucleophosmin | Novus Biologicals | NBP1-04323 | A065101 |
| p130/RBL2 | Novus Biologicals | H00005934-M03 | D3151-1E2 |
| p97/VCP | Novus Biologicals | H00007415-M03 | 12178-4A8 |
| PAP-same as ACPP | US biological | P9054-67H | L11092257C13020764 |
| PHGDH | Novus Biologicals | H00026227-M01 | D2191-52 |
| PhIP | Novus Biologicals | H00055023-M01 | D1281-4D7, 12178-4D7 |
| PIP3/BPNT1 | Novus Biologicals | H00010380-M01 | 08297-2E1 |
| PKA R2 | Novus Biologicals | NBP2-02520 | A01 |
| PKM2 | My Biosource | MBS200150 | |
| PKM2 | My Biosource | MBS200150 | A1018601 |
| PKP1 | Novus Biologicals | NB110-13474 | 130202618 |
| PKP3 | Novus Biologicals | NBP1-97675 | 1123 |
| PLEKHC1/Kindlin-2 | Novus Biologicals | H00010979-M09 | D4161-2G11 |
| PRDX2 | Novus Biologicals | H00007001-M01 | CA081-S1 |
| PRKCSH | Novus Biologicals | H00005589-M01 | 08297-3H7, 09114-3H7 |
| Prohibitin | Novus Biologicals | H00005245-M01 | D3191-S3 |
| Proteasome 19S 10B | Novus Biologicals | NBP2-01028 | A01 |
| Proteasome 20S beta 7 | Novus Biologicals | NBP2-01832 | A01 |
| PSAP | Novus Biologicals | H00005660-M01 | 12265-S1 |
| PSMA | Novus Biologicals | NBP1-45057 | 516937 |
| PSMA1 | Novus Biologicals | H00005682-M01 | 11280-S3 |
| PSMA1 | Novus Biologicals | H00005682-M01 | D5031-S3, D5311-S3 |
| PSMD7 | Novus Biologicals | H00005713-M01 | 08130-2G5 |
| PSMD7 | Novus Biologicals | H00005713-M01 | D5311-2G5 |
| PSME3 | My Biosource | MBS850788 | no lot No. |
| PSP94/MSP/IGBF | Novus Biologicals | H00004477-M08 | 12118-3B11 |
| PTBP1 | Novus Biologicals | H00005725-M01 | D3151-3H8 |
| PTEN | Novus Biologicals | H00005727-M01 | 12055-2G9 |
| PTPN13/PTPL1 | R&D SYSTEMS | MAB3577 | XXI0109051 |
| Rab1A | Novus Biologicals | H00005861-M07A | 08231-3f10, 11258-3f10 |
| RAB3B | Novus Biologicals | H00005865-M01 | D3191-3F12 |
| Rab5a | Novus Biologicals | NBP1-04340 | A088001 |
| Rad51b | Genetex | GTX11050 | 12257 |
| RPL10 | Novus Biologicals | H00006134-M01 | 07295-3H7 |
| RPL10 | Novus Biologicals | H00006134-M01 | D5311-3H7 |
| RPL14 | Novus Biologicals | H00009045-M01 | 09244-1B4 |
| RPL14 | Novus Biologicals | H00009045-M01 | 09233-1B4, 09244-1B4 |
| RPL19 | Novus Biologicals | H00006143-M01 | 12115-3H4 |
| RUVBL2 | Novus Biologicals | NBP2-01764 | A01 |
| SCARB2 | Novus biologicals | H00000950-M01 | 08312-1c8 |
| seprase/FAP | R&D systems | MAB3715 | CCHZ0212041 |

TABLE 26-continued

Antibodies

| Target | Vendor | Catalog# | Lot# |
|---|---|---|---|
| SerpinB6 | Novus Biologicals | NBP2-01650 | A01, A001 (same conc.) |
| SET | Novus Biologicals | H00006418-M01 | D2041-S1 |
| SH3PX1 | z | NBP2-02609 | A01, A001 (same conc.) |
| SLC20A2 | Novus Biologicals | H00006575-M04 | 08153-4b1 |
| SLC3A2/CD98 | Novus Biologicals | NB600-772 | 0610 |
| SLC9A3R2 | abcam | ab151443 | GR121588-1 |
| SMARCA4 | life technologies | 730011 | 1139083A1 |
| Sorbitol Dehydrogenase | Novus Biologicals | NBP2-02126 | A01 |
| SPEN/RBM15 | Novus Biologicals | H00064783-M19 | 08295-2C1 |
| SPOCK1 | R&D | MAB2327 | XCX0108121 |
| SPR | Novus Biologicals | NBP2-03257 | A01 |
| SRVN | Novus Biologicals | H00000332-M01 | 12101-5B10 |
| Stanniocalcin 2/STC2 | Novus Biologicals | H00008614-M08 | 11252-2B11 |
| STEAP1 | Novus Biologicals | NBP1-07094 | A0912501 |
| Synaptogyrin 2/SYNGR2 | Novus Biologicals | H00009144-M01 | 08312-5C3, 08318-5C3, 6286-5C3-00LcY5 |
| Syndecan | NOVUS BIOLOGICALS | NBP1-43351 | E04056-1632 |
| SYNGR2 | Novus Biologicals | H00009144-M01 | D5311-5C3 |
| SYT9 | NeuroMab | 75-306 | 449-3AK-64 |
| TAF1B/GRHL1 | MYBIOSOURCE | MBS120474 | no lot given |
| TBX5 | Novus Biologicals | H00006910-M01 | 12250-1G10 |
| TGFB | Novus Biologicals | NBP2-00426 | E05980-1630 |
| TGM2 | Sigma Aldrich | WHO007052M10 | 11294-2F4 |
| TGN46/TGOLN2 | Novus Biologicals | H00010618-M02 | 11350-2f11 |
| TIMP-1 | Sigma-Aldrich | WH0007076M1 | 11025-4D12, 11097-4D12 |
| TLR3 | Abcam | ab13915 | GR123770-1, GR117728-1 |
| TLR4 (CD284) | Novus Biologicals | H00007099-M02 | 12250-3B6 |
| TLR9/CD289 | Novus Biologicals | H00054106-M03 | D1111-1E8 |
| TM9SF2 | Novus Biologicals | H00009375-M12 | 09247-1C2 |
| TMBIM6 | ACRIS | AM20308PU-N | AB090612A-01 |
| TMPRSS1 | NOVUS BIOLOGICALS | H00003249-M02 | 10341-2D5 |
| TMPRSS2 | Millipore/Calbiochem | ST1676-100UG | 08162-2F4, 11027-2F4 |
| TNFR1 | US biological | T9162-51 | L13020614C13020614 |
| TNFRI | R&D systems | MAB225 | IP0912041 |
| TNFRII | R&D Systems | MAB2261 | BQH0310061 |
| TNFSF18/GITRL | Novus Biologicals | H00008995-M01 | D5311-6F7 |
| TNFα | Novus Biologicals | H00007124-M04 | 07254-S1 |
| TNFα | Novus Biologicals | H00007124-M04 | D5311-S1 |
| Tollip | Novus Biologicals | NBP1-28621 | L5505-T719C, L5505-T719D |
| TOM1 | Novus Biologicals | H00010043-M01 | D3131-5A3 |
| TOMM22 | Novus Biologicals | H00056993-M01 | D2251-4g4, D3011-4g4 |
| Trop2/TACSTD2 | eBioscience | 14-6024-82 | E13280-103 |
| TSNAXIP1 | Novus Biologicals | H00055815-M04 | 07205-1D6 |
| TWEAK | R&D systems | MAB1090 | VIV0110091 |
| U2AF2 | Novus Biologicals | H00011338-M03 | 11305-5G8 |
| uPA | Novus Biologicals | NBP1-05160 | U 16-0109-001 |
| uPAR/CD87 | BD pharmingen | 555767 | 2104802 |
| USP14 | Novus Biologicals | H00009097-M04 | 12195-6D6 |
| USP14 | Novus Biologicals | H00009097-M04 | 12195-6D6 |
| VAMP8 | Novus Biologicals | NBP1-40484 | YJ032819CS |
| VASP | Novus Biologicals | NBP2-00555 | A01 |
| VDAC2 | Novus Biologicals | H00007417-M01 | 12194-3D2 |
| VEGFA | Novus Biologicals | NB110-60975 | 2012081301 |
| VEGFR1/FLT1 | US biological | V2110-16N | L13053059 C13053059 |
| VEGFR2 | Novus Biologicals | NBP1-18646 | 0511R07-3 |
| VPS28 | Origene | CF505691 | |
| XRCC5/Ku80 | Novus Biologicals | H00007520-M02 | 11350-3D8, 10096-3D8 |
| XRCC5/Ku80 | Novus Biologicals | H00007520-M02 | D5311-3D8 |

The method is used to develop aptamer to substitute for the antibodies in Table 26. The aptamers are used for capture and/or detection of microvesicles of interest. The method is used to develop aptamers to EGFR, TOMM22, NDRG1, VDAC2, KLK6, MMP7, EDIL3 (del-1), CCR5, BDNF, Hsp10, GOLPH2, Hsp40/DNAJB 1, KLK4, LGALS3BP, p130/RBL2, SCARB2, Stanniocalcin 2/STC2, TGN46/TGOLN2, ANXA2, TMPRSS1, KLK14, SPEN/RBM15, ME1, PhIP, ALDOA, MMP25, NCL, EDNRB/EDN3, MTA1, CDH1, KLK15, CHRDL2, CXCR3. The method is used to develop aptamers to CD81, EDN-3, Cytochrome C, CD10, CD151, seprase/FAP, HGF, PAP, CD41, IGFBP-2, TWEAK, MMP 2, H3F3A, DDX1, 99-14-3-3 zeta/beta, IDH2, CD49d, KLK12, DCTN2-50, Histone H4, EDIL3 (del-1), CD9, COX2, hnRNP M1-M4, CDH2, SPEN/RBM15, 81-Prohibitin, SYT9. These aptamers are used with an anti-E Cadherin (CDH1) antibody or aptamer to for a capture/detector pair to detect microvesicles of interest. The microvesicles are identified to distinguish prostate cancer samples from non-prostate cancer samples.

Although preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (241535 sequences)

SEQ ID NO: 1 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgaatcacatgacttgggcgggggtcg

SEQ ID NO: 2 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaaagttaagcccattacccgcaacgatgc

SEQ ID NO: 3 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaaatacagtaaattgtatattagatacta

SEQ ID NO: 4 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaaccctctatcatgtatgatttgcgttac

SEQ ID NO: 5 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaactcatgccaccacatggtctctgcttt

SEQ ID NO: 6 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaagacgtatcaacccgtaggcataattgg

SEQ ID NO: 7 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaagctaactgagttatctagtatctccgt

SEQ ID NO: 8 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaaggcccggtgatcactagttagttggct

SEQ ID NO: 9 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacaccgagaagtaaccatttttagtccgg

SEQ ID NO: 10 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacacgaaacccaatgggcttgttagctac

SEQ ID NO: 11 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacagaacgggttacggggcctcaagtctg

SEQ ID NO: 12 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacattaggactatacacagtgtttgcgct

SEQ ID NO: 13 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaccaaaatcgggctttcgtaagtgaagaa

SEQ ID NO: 14 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacccagactgtcacgtctgaagggatctc

SEQ ID NO: 15 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaccccggagatgcagtagcttttcgtccg

SEQ ID NO: 16 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacgcggagttgttggaagacttgtcctgt

SEQ ID NO: 17 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacggaagtagcatcattcggagcggctta

SEQ ID NO: 18 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacgtaactgtgcgggcaggctctgtgtgt

SEQ ID NO: 19 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacgttgtgcatttttactcgcgtcggtcg

SEQ ID NO: 20 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaactagcggaccgcaggaccaccgggtagt

SEQ ID NO: 21 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaactcgctctttacgatggttgtcgcttct

SEQ ID NO: 22 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaactggtcggataatcgttgttcttcacct

SEQ ID NO: 23 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaactggtttcggcaagtaggtgtcgatgta

SEQ ID NO: 24 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaacttttaatgccatggcggcgcgtgtgtt

SEQ ID NO: 25 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagacttcggagcttatgcccttctttgcc

SEQ ID NO: 26 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagataagtctggcattttttggggttttc

SEQ ID NO: 27 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagcacaactgccactctgtcctagctgtg

SEQ ID NO: 28 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagcataggtgagccgactacggttgtaat

SEQ ID NO: 29 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagcattgcgggggagagttcttagacatg

SEQ ID NO: 30 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagccgaactgtgcgatctcttgattccac

SEQ ID NO: 31 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagcgtcgtaccccaaaaaagctgttggat

SEQ ID NO: 32 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagctagtctctcatttgcgcgggatggtg

SEQ ID NO: 33 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagctcgtcagactccttgagccgggacgc

SEQ ID NO: 34 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaggaacttaccacctttgttgcccgaggg

SEQ ID NO: 35 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaggagtccagggccgttgtcatgcagtcg

SEQ ID NO: 36 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaggcaatcagtgccgacttggctatcagg

SEQ ID NO: 37 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaggcgcagtccttctatccacgagcgaac

SEQ ID NO: 38 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaggctggtctggccacgatggttcacgta

SEQ ID NO: 39 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagggattggtccaatatgggaagcgtggt

SEQ ID NO: 40 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagggcactttcgatgtggtaatgtatcac

SEQ ID NO: 41 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaggtccagtgtggggttgaataagcaatc

SEQ ID NO: 42 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaaggtcggttttatccgcgaacgacccttg

SEQ ID NO: 43 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagtagtttcttgtcgactactagaatact

SEQ ID NO: 44 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagtcctgttttgtttcatcggcattaatt

SEQ ID NO: 45 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagtcgatgattcgattgcgtctcgtgtgt

SEQ ID NO: 46 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagtcgcccgaatgattcaaccgggaattt

SEQ ID NO: 47 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagttctgcatttggccagcataggcttgg

SEQ ID NO: 48 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaagttttaccggctactactctgaggcctt

SEQ ID NO: 49 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatacgttgagtccagattctagttgccgt

SEQ ID NO: 50 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatattcttcgactcacgttcctctgcagc

SEQ ID NO: 51 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatcaagaagtgcgtgtattaacttttagc

SEQ ID NO: 52 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatcaagcgggtggtccccattgtagattg

SEQ ID NO: 53 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatccgcggtcgatagggcttccagaaagg

SEQ ID NO: 54 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatgcgagcaggccatagccacgtaactcg

SEQ ID NO: 55 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatgcggcgtgtcagtttgtccagtgcccc

SEQ ID NO: 56 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatggaatgctctcgtcccttccttccaac

SEQ ID NO: 57 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatggcttcactgactcggcgcgtaagctc

SEQ ID NO: 58 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatgggtacgcaatgctgtacgtcctggta

SEQ ID NO: 59 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatggtcgtactgtgtggtaaggtcgccaa

SEQ ID NO: 60 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatggttcagtccatatgcctgttcatgcg

SEQ ID NO: 61 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatggttgtatgagtatgctaagcttctcg

SEQ ID NO: 62 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaatgtttaagttaggacgttaaggccacgc

SEQ ID NO: 63 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaattaacgatcagctgcgggtattgttaac

SEQ ID NO: 64 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaattagatgtcaacctatactgtggtgcca

SEQ ID NO: 65 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaattaggcccgagcaatgtataggagtatt

SEQ ID NO: 66 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaattcttactgtctagttaagttttcattc

SEQ ID NO: 67 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaattgggcgccgaactagccacaagtagtc

SEQ ID NO: 68 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacaacccttttgatactctctacaaaaggc

SEQ ID NO: 69 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacaacgtgcgtggatcaaagctgtacgtaa

SEQ ID NO: 70 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacaaggaccagatctgctaggctttcgctg

SEQ ID NO: 71 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacaataatacgggtgttgtataataagcct

SEQ ID NO: 72 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacacagcgtgatcctcgacgggatagtatt

SEQ ID NO: 73 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacacatggccttggcgtaatcttcaactag

SEQ ID NO: 74 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacacctaagagtgaataatacagtgacggg

SEQ ID NO: 75 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacacgccggtcaaagacgcctggtgagagc

SEQ ID NO: 76 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacacgcttccggttatgaggcattctaatt

SEQ ID NO: 77 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacacggcaagtggaatggtgatgcataatg

SEQ ID NO: 78 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacactgacggcggcttaccttttgtgctgg

SEQ ID NO: 79 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagacatggtggggtcatggacagttctg

SEQ ID NO: 80 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagatcgttaataggaacttacctcgcga

SEQ ID NO: 81 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagcagcagtgttcaaaggttgtactttc

SEQ ID NO: 82 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagcccgcgaaatagcgtggccagttggt

SEQ ID NO: 83 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagcccggttgtgaacagggcggtgcaat

SEQ ID NO: 84 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagccctttacggttgtcaaaagcgtggc

SEQ ID NO: 85 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagcggcgctcacggggagacctgtgttg

SEQ ID NO: 86 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagctcagtggaatgcgggacgtggctgc

SEQ ID NO: 87 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacaggcagtgatgtatagagcctcccgtca

SEQ ID NO: 88 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacaggctattcacgattgcccgactagtta

SEQ ID NO: 89 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagggcgctcttccaggagtggtgtacta

SEQ ID NO: 90 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacagggtaatcgtaagatagtgcactgtta

SEQ ID NO: 91 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacaggtaatgtctggtcgctttttacacac

SEQ ID NO: 92 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacataccgaatcgggtgagagctgtcgtgt

SEQ ID NO: 93 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatacggtggtttgacgcctaagccgctg

SEQ ID NO: 94 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatcagcaactcatctccacgaatgttgc

SEQ ID NO: 95 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatcaggtcttggctcggagcctcgactg

SEQ ID NO: 96 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatcgacgtagacccaggtccagttcgcg

SEQ ID NO: 97 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatctgtcattctacataacttgctctct

SEQ ID NO: 98 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatgaatccaagatatgcttaagtagttg

SEQ ID NO: 99 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatgatcagttttggcgttgaacctaccg

SEQ ID NO: 100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacatggcggtatatacgtgatgcttgaagg

SEQ ID NO: 101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccaacgtctgacagggctgcctcgtttgt

SEQ ID NO: 102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccaacgttctaggtctattgaagtcaacg

SEQ ID NO: 103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccaatcgagtttcgaccacaaagtcatcg

SEQ ID NO: 104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccagaacggagcactttatctgaccacgg

SEQ ID NO: 105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccagagtgacctcactgatgggtgtccgc

SEQ ID NO: 106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccatgttttagatgctgcgaggcaggggg

SEQ ID NO: 107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccccggttgagcataactcgctgggttat

SEQ ID NO: 108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccctgccaggacggtcgctcaggcacgat

SEQ ID NO: 109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccgaaagcatccgacccgctagcaaatcc

SEQ ID NO: 110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccgaccttccgtggcatgttatacatgag

SEQ ID NO: 111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccgcaaatacgtagggcacaagcactcga

SEQ ID NO: 112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccgcagaacgcagccgatccatatcgtta

SEQ ID NO: 113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccgcggcccagtgatgtgaggcctatgcg

SEQ ID NO: 114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacctgacaacaaggcccggtgtctggctgg

SEQ ID NO: 115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacctgcgtactacgtattataccagtagtg

SEQ ID NO: 116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccttcaaaattcgcctcaccgtcggcccc

SEQ ID NO: 117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaccttgaattgacccggtattaaatcttat

SEQ ID NO: 118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgaaagcgatttgagttattgattggccc

SEQ ID NO: 119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgaaatgagcttttacaattctatgcgcc

SEQ ID NO: 120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgacacccttagcttcccacgaactcttg

SEQ ID NO: 121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgacatatactgcaaacgttgtgtcgccg

SEQ ID NO: 122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgaccaggcctcgtccgtcgtggcggtag

SEQ ID NO: 123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgacgcaggagaaatgaagtagtacgtgc

SEQ ID NO: 124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgagacccactgtttgatacattatgctc

SEQ ID NO: 125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgataaagtctcaccgtgaatgactccgt

SEQ ID NO: 126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgcattggggtgttatttagaccgctgca

SEQ ID NO: 127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgccaagctacaaagcagccctcccgtcg

SEQ ID NO: 128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgcctcattttgggatctgcattgttgcc

SEQ ID NO: 129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgcctctaggataggtagtcaagcgggcc

SEQ ID NO: 130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgcgaagggatgcaatatgggcgttgtcg

SEQ ID NO: 131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgcgcgggtttcaggtgcttacgtgaatc

SEQ ID NO: 132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgcgttctcatgtctttagttactctctc

SEQ ID NO: 133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgctagtgtgggcggagtgttctcgcaaa

SEQ ID NO: 134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgctcattttgcgggagtgcatccacggt

SEQ ID NO: 135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgctcttacagcctagctcaggcgctatt

SEQ ID NO: 136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggaccgtggagcggttattcggcgctga

SEQ ID NO: 137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggattacgggcaagttcacataatgtgc

SEQ ID NO: 138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggcaagggattcagtcattatctcgaac

SEQ ID NO: 139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggcagctgcgtgttttacggtacatacg

SEQ ID NO: 140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggcgcgccgctttctagccagacctact

SEQ ID NO: 141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggcggacaacaggatagattccgtgggc

SEQ ID NO: 142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggggaagccgcaatgtggtccagtcata

SEQ ID NO: 143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggggacagtggaatgtgcctgcctgatg

SEQ ID NO: 144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgggtcggggtatttattaagttctccga

SEQ ID NO: 145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgggttgactctttggatactcggtgagc

SEQ ID NO: 146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggtgaaagagtttggcgccggataagca

SEQ ID NO: 147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggtgaagggggttgaacgctatgggtac

SEQ ID NO: 148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggtgtataccttgttacgacacgacaac

SEQ ID NO: 149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacggtgtccttcagttgccccgtgccaggt

SEQ ID NO: 150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgtacagcttccacgggcaacggcactta

SEQ ID NO: 151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgtagggcatgtcgatggttgctactcgt

SEQ ID NO: 152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgtagttctgaccaccggtgtgcccgcgg

SEQ ID NO: 153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgtcctgccaccgtgcgatgtagcagaca

SEQ ID NO: 154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgtctcccgtgactcggttcattgctttg

SEQ ID NO: 155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgtgcttttatcgccggcactatactcgg

SEQ ID NO: 156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgtgtcccagagagaacttcgcacaactg

SEQ ID NO: 157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgttcaatggttttactcagtcatgaatc

SEQ ID NO: 158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgttccacttttcgcttaaagcaacgtcc

SEQ ID NO: 159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacgttcgtgtggatgtcctaccggctatct

SEQ ID NO: 160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactacaaagctgcgatgctgggatgttgga

SEQ ID NO: 161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactacaggtcctttcatgcctcagggtgta

SEQ ID NO: 162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactattgcggttcagatattcttgacgcgg

SEQ ID NO: 163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactcaacgcggcagtttattatgtttccac

SEQ ID NO: 164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactcagtgtgttcatcgtcacctgcgcctc

SEQ ID NO: 165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactcccagaattaaggctgggtattatgct

SEQ ID NO: 166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactccggcgctccagtccggtccgtgctgg

SEQ ID NO: 167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactcgcgccaatggtcatttttacccacat

SEQ ID NO: 168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactcgctcggagttgcacataactgatcgt

SEQ ID NO: 169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactcgctgccttcaaatttaatagtcgcgg

SEQ ID NO: 170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactcggtggctgaccattcacggttcgata

SEQ ID NO: 171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactgcgcgttacgctgcgtgcggtacgttt

SEQ ID NO: 172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactggacggaaatgctcgtgtgcactgcgg

SEQ ID NO: 173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactggagcttcgcggacggttgtgttcagc

SEQ ID NO: 174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaactggggctccggatggctatccatgatgg

SEQ ID NO: 175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttagtaaagtgtcaatcccatccgtcgc

SEQ ID NO: 176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttcagaatcccgccttgtttgtttacat

SEQ ID NO: 177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttgcggccacaaagtctatcgacgaggc

SEQ ID NO: 178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttgcgtgccgacttgtatatgtttgagc

SEQ ID NO: 179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttggaagccgggggatgctgtagggggt

SEQ ID NO: 180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttggattgtctacccgatttacatggcc

SEQ ID NO: 181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttggtcctcgttcatgtcctatctcctg

SEQ ID NO: 182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaacttgtgaagacaatcatcatgtacaggca

SEQ ID NO: 183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagaaacgtgtctatagagcgatgtttaatc

SEQ ID NO: 184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagaaagtgtcgagtcaacatgatgaggaag

SEQ ID NO: 185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagaacgttgggtgtgtacttcgttgctcct

SEQ ID NO: 186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagacaatggttgagtttcagaggtatggct

SEQ ID NO: 187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagactacctcgtgctctgctatactagcca

SEQ ID NO: 188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagactcagaagtgctattgaaacccacctc

SEQ ID NO: 189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagactcggctgtctgctgggatgccataac

SEQ ID NO: 190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagagccaaatttctggggtcgttcagtttc

SEQ ID NO: 191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagagtgtgtaatcctagggtacaagggtgt

SEQ ID NO: 192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagatccactgttagttagtagatcatacat

SEQ ID NO: 193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagatcgccgctggcttgcctagaatatctg

SEQ ID NO: 194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagattagagctggaagcggcgtgccagggg

SEQ ID NO: 195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagattccataacttcgtgtacaatactatc

SEQ ID NO: 196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcaacacaaccgatgttaggtacctagcg

SEQ ID NO: 197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcaagggtcgtatttgcgtgggattcccg

SEQ ID NO: 198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcaccccgtttgtaactggcccgtgtgat

SEQ ID NO: 199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcacgcgtaactcctcaattgtttggcgc

SEQ ID NO: 200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcagatgtacaaagcaatgtgtttgtcca

SEQ ID NO: 201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcagtttcttggttggggactctagcccc

SEQ ID NO: 202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagccacatcgataactgctcttgtcgaact

SEQ ID NO: 203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagccaggtagcttgttcttgttcctcgacg

SEQ ID NO: 204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagccatcgcttgtaactcgtcaagtatgtc

SEQ ID NO: 205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagccccgccatcgggtgtctcggtaagcgt

SEQ ID NO: 206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcccgatgcaaggttaggaaatgatggtt

SEQ ID NO: 207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcccggaatgagacacacacttcaccccc

SEQ ID NO: 208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgaaccacgcatagggataaactatgac

SEQ ID NO: 209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgatcatgcactcaatcttacgcccata

SEQ ID NO: 210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgcctaggctatgggtaatcgaaccatt

SEQ ID NO: 211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcggacagaccgcagcgaaaaggggcgcc

SEQ ID NO: 212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgggcgaaagacaattgctccacctact

SEQ ID NO: 213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgggttatgacggagttcgccctgtttc

SEQ ID NO: 214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgtaccgtttatgcatcttggttgctgt

SEQ ID NO: 215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgtcggaggtataccagaagttagagtg

SEQ ID NO: 216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgttagtacaatttggctctgagtacaa

SEQ ID NO: 217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgttatcaaacagcgggacgtttctgct

SEQ ID NO: 218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcgtttatgcggtgagttcaaggtttctt

SEQ ID NO: 219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagctccctagccttattcaagacccccacg

SEQ ID NO: 220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagctctttgtgaggattggtaggtcggctg

SEQ ID NO: 221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagctgttcctatcctgtcagcatgacttgg

SEQ ID NO: 222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcttcgtgtctaggttttttatatagttc

SEQ ID NO: 223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcttgaacctgacactcgttagtattgag

SEQ ID NO: 224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagcttgttcatacgtaagcaaggggaattg

SEQ ID NO: 225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagctttttcgaagtttcttggcacgttctg

SEQ ID NO: 226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggaaatcgtcatagatgacggcttgccga

SEQ ID NO: 227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggaacttttaatggcagggaggtgtgggg

SEQ ID NO: 228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggaatgttggacgctaaagactggtttag

SEQ ID NO: 229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggacagggtgcgcggttgtgcctgctgcg

SEQ ID NO: 230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggacttggtcaaggtgtgtcatcgggacg

SEQ ID NO: 231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggagacatcagaggcggaaacagtatagg

SEQ ID NO: 232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggagtacaatgccggtaatctctgtacgc

SEQ ID NO: 233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggatcttaagtacgccggtttactcaggt

SEQ ID NO: 234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggatgccgtccgcgtatcttttcgagcgt

SEQ ID NO: 235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggcaggtgtaatcgcggtatcccacacac

SEQ ID NO: 236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggcatcaggtgagtgctatgcgccgaggt

SEQ ID NO: 237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggccaaggaaacatgttggagctcgtcgg

SEQ ID NO: 238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggccggcaaagaatccgcgattgttgcct

SEQ ID NO: 239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggcgaaccttggtgggaccggagaattgc

SEQ ID NO: 240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggctcatacgcttatttgtacagacgggg

SEQ ID NO: 241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagggaacggttaggcactgcggaatgtggt

SEQ ID NO: 242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagggaatccacacgcccgtagttccgccgg

SEQ ID NO: 243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagggagcaccatttttaacccgcgcatgag

SEQ ID NO: 244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagggcagctctcgtctagggtctttgtaca

SEQ ID NO: 245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagggtaagtcttagtgtgacatgcattggc

SEQ ID NO: 246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagggtgactcataggtcaagccggagtact

SEQ ID NO: 247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagggttagagttcgcagatcttcgtcagag

SEQ ID NO: 248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggtattgtgatgtagggcacctgtggtag

SEQ ID NO: 249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggtgcagtcaggttcccaatgccttgcac

SEQ ID NO: 250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaaggttggaagtctagagggcaaacacaagg

SEQ ID NO: 251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtaatagaatggtacggttctgaattgtc

SEQ ID NO: 252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtacctctgtattgtgcttaccggtgcga

SEQ ID NO: 253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtacggatgtgcaacatcgctgtccgtcg

SEQ ID NO: 254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtacgggccaccccaagcgtggtcatgag

SEQ ID NO: 255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtactgggccccgagataaagtatgttct

SEQ ID NO: 256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtagcgaaggaaattgctccggactggac

SEQ ID NO: 257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtccagtatagagaacctcttgtcatgtg

SEQ ID NO: 258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtccgtgctttacatgcttctcgatttcg

SEQ ID NO: 259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtcctatagcatcggtgctgacctatgga

SEQ ID NO: 260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtcggccgatctgtcgggaaatgctcttc

SEQ ID NO: 261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtcgggtgacgcatgcaggttcggagggt

SEQ ID NO: 262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtctactcgttgcagagccctcgttcacg

SEQ ID NO: 263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtctcctcctatggtagcttcattgttgg

SEQ ID NO: 264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtcttgcgggtcatttttacttatccacg

SEQ ID NO: 265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtgaccttacaaggcgactggagtttgtg

SEQ ID NO: 266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtgatatggcaacgttgcgcgcgggtgct

SEQ ID NO: 267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtgcccgcaaaactacggtctaaggacaa

SEQ ID NO: 268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtgcgcctcacctaaccttggcccggccg

SEQ ID NO: 269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtgcggggtggcaatcgcgatcatggagg

SEQ ID NO: 270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtgggaggtggacagctaaatgtggcggc

SEQ ID NO: 271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtgtgctttgatggactgcctggctcttt

SEQ ID NO: 272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagttgctttatgaggctcgagttaaagttg

SEQ ID NO: 273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagttggattgaattcgacacactcaagtgg

SEQ ID NO: 274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagttgtggataggccactcaaaatgcatgc

SEQ ID NO: 275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtttccggacgatcaccgaaattctcgtc

SEQ ID NO: 276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaagtttcgaaccttctcttgatactgttccc

SEQ ID NO: 277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaataaacacgtggttggtacccgatttgtct

SEQ ID NO: 278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaataaaggccccctggtactctatcatacga

SEQ ID NO: 279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaataacgtttcatccgtgcgtccactcccac

SEQ ID NO: 280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatacactgccctttatgctctcgacccacg

SEQ ID NO: 281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatacaggcccaggggtagctgcaatgcaga

SEQ ID NO: 282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaataccggaaagaacagatatgtttttagac

SEQ ID NO: 283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatacgcaccagcgaacaagctgtgcctgtg

SEQ ID NO: 284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatactgccatcgcgacgtatctgtacttcg

SEQ ID NO: 285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatagacgtcagttgcggatccactgcaaaa

SEQ ID NO: 286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatagatagcatttggctgatgtacgaatgg

SEQ ID NO: 287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaataggagtggaacggtggtgcgaccggtcg

SEQ ID NO: 288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaataggcattttccttgtcagacagtctcgt

SEQ ID NO: 289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaataggtcggcataccgtcgcgactagcggg

SEQ ID NO: 290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatagtcccttaggaaaccggagtgatagcc

SEQ ID NO: 291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatagtgtagctaccggtgagggtaaacact

SEQ ID NO: 292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatatatcgaggtttaggtcccttccactaa

SEQ ID NO: 293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatatgctggttttgcgcacatctgcgtggc

SEQ ID NO: 294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatattacaggaaagcacgtcggaccttttc

SEQ ID NO: 295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcaagcttataaatatttctcctttcgtt

SEQ ID NO: 296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcaatggacacaatataaggttttttcgt

SEQ ID NO: 297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcaccgttatgaacgaggccaactccata

SEQ ID NO: 298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcacgaactacctttttatccggtcggca

SEQ ID NO: 299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcacgacttcgcaaggtcccagcatatga

SEQ ID NO: 300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcagcggttcgggccgttaaagtctggaa

SEQ ID NO: 301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcatcgcttcggatgcttaagggtgatat

SEQ ID NO: 302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcatgcagcggcgtgtggcagatatgctt

SEQ ID NO: 303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatccgagtcaggcaattctaagctcgttgg

SEQ ID NO: 304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatccgggcgagtgattcctcttcgggacga

SEQ ID NO: 305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcctgtcggggtcgggctcacttctggct

SEQ ID NO: 306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgaccgcgtgtattggtagtattgtgct

SEQ ID NO: 307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgactcagatccagttcgtcttagtttt

SEQ ID NO: 308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgaggaatgtaacgtgcgaaagaagtca

SEQ ID NO: 309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgataaggtgagaggaacctgtctactc

SEQ ID NO: 310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgattgcgtgttatctgttagggttggc

SEQ ID NO: 311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgcagcggttaaaggagacaatgctggg

SEQ ID NO: 312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgcttttctcaatgcagcttccatgatc

SEQ ID NO: 313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcggaggatcttccgttcaccgctgcagg

SEQ ID NO: 314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgtgcgaatccttcgtgacctatcggcc

SEQ ID NO: 315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatcgtggatttggagggttgtggtgctcat

SEQ ID NO: 316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatctacaaacggggttccagtcttaattgt

SEQ ID NO: 317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatctccacttgtatttctcaattcggattg

SEQ ID NO: 318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatctcgcatacgacgccttaagcggattaa

SEQ ID NO: 319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatctctgggtctatcaccctctcgtatctg

SEQ ID NO: 320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatctgatacgcctaacaagctagtggaaac

SEQ ID NO: 321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgaacgccgaagggcaaaatgttgggtcc

SEQ ID NO: 322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgacaagggaagagagacaagtaaaccgt

SEQ ID NO: 323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgacggcaaggatggagtggcgaataggg

SEQ ID NO: 324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgaggggactcctactacgagtagtaact

SEQ ID NO: 325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgatcatattcaagccacgtgtagaaata

SEQ ID NO: 326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgctccttattacggcaaggtctccttcg

SEQ ID NO: 327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgcttgatgcggttggtaggtcgtggctc

SEQ ID NO: 328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatggaacagcgagggagacgagacgggatt

SEQ ID NO: 329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatggatatccatgagtcgaatgattgacct

SEQ ID NO: 330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatggccgtgtaaagtaagacaactggggga

SEQ ID NO: 331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgggcaactctggtggcgacgtatgatgg

SEQ ID NO: 332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatggtaagctcgtgggtcaattgggggtac

SEQ ID NO: 333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatggtccctattgatttggtaatacacttc

SEQ ID NO: 334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgtaaggcaggtgttgcttaggctggtga

SEQ ID NO: 335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgtcatgccaggcgccaaagtggaagagc

SEQ ID NO: 336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgtcgccggatgcacggacgtctgatttg

SEQ ID NO: 337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgttatctgggcggtcgccatgcttggtc

SEQ ID NO: 338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatgttgggatgccaagttctagaaaatgcg

SEQ ID NO: 339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattacgtagtcaacatagtctcatattatc

SEQ ID NO: 340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattagtctcgattctttcttgcccatcatt

SEQ ID NO: 341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattatacttgtgcatgatgtttacacttac

SEQ ID NO: 342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattatggagagaaagggatcctcgttattg

SEQ ID NO: 343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattcatagctttcgcagagtttgatccctt

SEQ ID NO: 344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattccgttgcgagaaaggcggagacgggcg

SEQ ID NO: 345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattccgttggaagattcgaagatttgtcta

SEQ ID NO: 346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattcgttttgaactaagtcctttcctctgg

SEQ ID NO: 347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattctcggatgcctactctaatgggtgggg

SEQ ID NO: 348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattgaacggattgagattgttttatttgat

SEQ ID NO: 349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattgaatgctagtttggagttctctgtgga

SEQ ID NO: 350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattgactgccgcgaaatggaagttgacgct

SEQ ID NO: 351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattggcgatcgcaaggttagctaggactta

SEQ ID NO: 352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattgtgggactcggagataattactcggtg

SEQ ID NO: 353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatttaactttttcaacttgatactgcgtac

SEQ ID NO: 354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatttaccggaaccgatccgagtaaaccact

SEQ ID NO: 355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatttagttcatgaaatctgtgtgtatcggg

SEQ ID NO: 356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatttccaggtcatgcagccttacatttctc

SEQ ID NO: 357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaatttggaaaagcgtgacgatggtatcggtt

SEQ ID NO: 358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaattttggagaagttacgtgtatgttattag

SEQ ID NO: 359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaacagtaattatccatcttatatggata

SEQ ID NO: 360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaatattcgttgctcgcggggttgtgtga

SEQ ID NO: 361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaatgtgttccgactttgctggtggaccc

SEQ ID NO: 362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaatgttggctaagctgcacgcaggtccc

SEQ ID NO: 363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacacgtcaaacgagtccctcctagtcgg

SEQ ID NO: 364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacagtaatcagctacgcacgcatgtacg

SEQ ID NO: 365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacatactccctgcctgtgctgcgcggat

SEQ ID NO: 366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaccatccgcgcgatgtgcctctccggct

SEQ ID NO: 367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaccgttacgtcacgtgggttgtatgcca

SEQ ID NO: 368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacgaatcgggaatccacaaaaagggcat

SEQ ID NO: 369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacgctgggcaaccgatacagcaacagcc

SEQ ID NO: 370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacggcgatggggcttctgtactcttcgg

SEQ ID NO: 371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacgggagtgcgcctgtgtttctcgaccc

SEQ ID NO: 372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaacttcctgagcgataccaacgctttatc

SEQ ID NO: 373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaagcatgctcaccgggtatcattacaatc

SEQ ID NO: 374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaagccgaaccgtgattcaccaacatcgtc

SEQ ID NO: 375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaagggtccgtggcctatgtccccagggct

SEQ ID NO: 376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaagggtgttggtgagagaagtcggcgcgc

SEQ ID NO: 377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaggtacagttctctcgtccgtctagcgg

SEQ ID NO: 378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaaggtttggagaagaacggggcttctggc

SEQ ID NO: 379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaataaggagactttgtaagccgactcctc

SEQ ID NO: 380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaatcttgattaggtaactatgtgtacggc

SEQ ID NO: 381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaatgcacaccggagtattagttcgccggg

SEQ ID NO: 382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaatgcccagacgaaaccaaggttgtctta

SEQ ID NO: 383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaatggccaggccaatggatttgcggcgca

SEQ ID NO: 384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaatggctttattctcgacagaacggtttc

SEQ ID NO: 385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaattcatgtagtaagcccccacaggagac

SEQ ID NO: 386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacaaggtgtaccctgtgatgcgtaacgat

SEQ ID NO: 387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacaatagatacgataatgtgacgaactta

SEQ ID NO: 388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacaccggaaaattgtattatttgcatcgg

SEQ ID NO: 389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacagggaagtggagagcgcgtattgcctt

SEQ ID NO: 390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacaggtgaccgtctgctaggtcggcgttt

SEQ ID NO: 391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacataatcgagccacccggcaccaggggg

SEQ ID NO: 392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacataccccgatattgacacggtttgagg

SEQ ID NO: 393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacatcagtcaagctaagtcccggggctca

SEQ ID NO: 394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacatcgcgcgttgtgcggaggaccacttc

SEQ ID NO: 395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacatcgtgagatgggcatcacaccactgt

SEQ ID NO: 396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacatgcgtcctcttatcactttactagga

SEQ ID NO: 397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacattcgaagtttgtggatgcgttactag

SEQ ID NO: 398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaccaaccaaagcggtcctaacgctacggg

SEQ ID NO: 399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaccagctgtcgtcttacgtttgttctgat

SEQ ID NO: 400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacccggacgagttcgcttagccgcattct

SEQ ID NO: 401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaccgcgacactcgatagtatagggccatg

SEQ ID NO: 402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaccgcgttgtcgtatctaccatagttgag

SEQ ID NO: 403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaccggatcggatgactgtggatctggtcg

SEQ ID NO: 404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaccgtccgctacggaaatctcagggtcgg

SEQ ID NO: 405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacctaaaggcacccgccagcgtccatgcg

SEQ ID NO: 406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacctaggtattggtacgcgcttttaagat

SEQ ID NO: 407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacctggtccatgaactatgttaggtggag

SEQ ID NO: 408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgactcgtcttggactcgcgctcatatc

SEQ ID NO: 409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgactggggacactgcgcttgtgggaca

SEQ ID NO: 410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgatacgaggttggttcaaagaccgggg

SEQ ID NO: 411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgatgggctccgggtcttgcggttgtgt

SEQ ID NO: 412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgcagcaacatgtcggccaccctgccgc

SEQ ID NO: 413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgccgtcgcggacacgctccccaagacc

SEQ ID NO: 414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggagggcttgtcgaccccgtatacgta

SEQ ID NO: 415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggatcgttatgcgataccacggacggg

SEQ ID NO: 416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggcagaatttcctcaatttcgatgtga

SEQ ID NO: 417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggcctccgttattgaccaatgggccga

SEQ ID NO: 418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggcgacccgtttggactctcctacacc

SEQ ID NO: 419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggcttccctctaggtcttgtctcgtgt

SEQ ID NO: 420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggggatcttattgatgggctcgcggtc

SEQ ID NO: 421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggtcaggggcacgttggaactgctagc

SEQ ID NO: 422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggtgggcaagccgcatactcgcgtagg

SEQ ID NO: 423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacggttctggtaataactgctcagcctaa

SEQ ID NO: 424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgtaagacccggggaaatggagtggagg

SEQ ID NO: 425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacacgttgaacggggtcggctgtattggcgc

SEQ ID NO: 426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactacttcggctaggtggtaatgtctcga

SEQ ID NO: 427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactatcagagcccaatagcattcctcagc

SEQ ID NO: 428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactcataaccggtgctaatatacgacacg

SEQ ID NO: 429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactccggatatatattgatgttagcataa

SEQ ID NO: 430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactcgggagcggtgggcggcatttgtctc

SEQ ID NO: 431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactgcgagagagctgtgggacgacggggt

SEQ ID NO: 432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactgcgcgtcttactcgtagatcttggtt

SEQ ID NO: 433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacactgcttctgcgtttaggtttgtttgtct

SEQ ID NO: 434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagaacactttgcaccgaaaagctcccttt

SEQ ID NO: 435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagaagttactcgcctctcgacacaccgta

SEQ ID NO: 436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagacagtccacatgttccaatggccgggg

SEQ ID NO: 437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagacatccgggatacttatggtgagatcg

SEQ ID NO: 438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagacccgcgcagagttgtaccgtcgggcg

SEQ ID NO: 439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagacggaagcttgctaacagtgacgcgaa

SEQ ID NO: 440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagactatgccgtgttagagtactctgatt

SEQ ID NO: 441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagatcgcgattgatttaattgtatcgtac

SEQ ID NO: 442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagatctcttggggtttctctttatcaacc

SEQ ID NO: 443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagcaggattccaccgggatgcaagccttc

SEQ ID NO: 444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagccaacgactcttggtccctacgcgact

SEQ ID NO: 445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagccaggaccaataatgtgacaaaaccgg

SEQ ID NO: 446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagcccttgggtaggtcggtcgttgcacat

SEQ ID NO: 447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagccgcggagtagagacaggccggttgga

SEQ ID NO: 448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagcctgcagttcgatttgggtaggttggt

SEQ ID NO: 449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagcgaatgacagcttaccttgtttactaa

SEQ ID NO: 450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagcgaccaaccgtgtactatgcggccttc

SEQ ID NO: 451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagcgggcttgttgacgtatttagcgtgaa

SEQ ID NO: 452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagcggtccatagcgcggattgactcggac

SEQ ID NO: 453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagctgagggaggctgtatacaggatgcct

SEQ ID NO: 454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagctgctacggcgcatgaccctcccgcac

SEQ ID NO: 455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaggaaccgggcaagacgagtccgcactgt

SEQ ID NO: 456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaggacgtgcagctagtcactagggattcg

SEQ ID NO: 457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaggatatgcttcccgctgaatacggtttt

SEQ ID NO: 458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaggcggtggttcaagtgatgcatttagtg

SEQ ID NO: 459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaggctttcttattaatctatgccagttcc

SEQ ID NO: 460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagggaagtacggcgcctaggacgatacac

SEQ ID NO: 461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagggaatttccatggagctgaatcttgga

SEQ ID NO: 462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagggactcattttgccttagcggacatgg

SEQ ID NO: 463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaggtgcgatccccggcgtaggagtgttat

SEQ ID NO: 464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacaggttgcttcctcttaagcccgcatatgt

SEQ ID NO: 465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtaattacccggtggatctcccggacgc

SEQ ID NO: 466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtaccgccgccttgcgatgtattaccgg

SEQ ID NO: 467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtataaacctcacatcttgctgcaagtc

SEQ ID NO: 468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtatcaccttgtaccacgtttctcccac

SEQ ID NO: 469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtcagttggggcagctcgagcaatccgc

SEQ ID NO: 470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtccctaggtgcgcgtactgcatggtgt

SEQ ID NO: 471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtgcaatggtcggccatgggctcgctgg

SEQ ID NO: 472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtggggttagcaggggcacttttcagcg

SEQ ID NO: 473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtggtccttctgtacattaaccactttc

SEQ ID NO: 474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtgtgacctgcccttaaccgtgggtagc

SEQ ID NO: 475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtgtgctctattgcggaatacaactgta

SEQ ID NO: 476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtgttcgttgtccggtagcagcactcac

SEQ ID NO: 477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagtgtttggaatttggagtagctccaata

SEQ ID NO: 478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagttagctcgatcattccctctcggtgtg

SEQ ID NO: 479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagttccttgttattgagccatatagcata

SEQ ID NO: 480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagttgcgcggtgtgtcttagttttcacga

SEQ ID NO: 481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacagttgctctggccagcaagctcactccac

SEQ ID NO: 482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacataactcacttaggttggaggcggcgacg

SEQ ID NO: 483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacataagcgtccggtaattccctacgcctgg

SEQ ID NO: 484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacataagtttgccagcgtgcggccacgtagg

SEQ ID NO: 485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacataatccgctcaagccgtcacgtaggccc

SEQ ID NO: 486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatagggccggatgttgatggacttggacg

SEQ ID NO: 487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatagtccgccttatctggctttaaggaac

SEQ ID NO: 488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatagtttacaattaactctgcataggata

SEQ ID NO: 489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatcgcctttacgtcatcactccatctttt

SEQ ID NO: 490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatcggcccgagacggggaacagttctggg

SEQ ID NO: 491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatcggcggtaccatggacctcccatagct

SEQ ID NO: 492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatcgtgtggtctcccgacgctcagattta

SEQ ID NO: 493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatctgcgggttttatgcgagtgacgggcc

SEQ ID NO: 494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatctttatgagccaaatctgcgctttgag

SEQ ID NO: 495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgaagtcatatgacgatatccgttgtat

SEQ ID NO: 496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgagtgctgaacggcatactcgcttaac

SEQ ID NO: 497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgatgttcagtgctgtcttcgtatggtg

SEQ ID NO: 498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgcgcaaccatatcggcgcggggtcggg

SEQ ID NO: 499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgcgcaatcgtgtttatgcgcggattta

SEQ ID NO: 500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgcgcagcaccctcacagtacgtcgctg

SEQ ID NO: 501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgctgatcttgctcgtggacttatggac

SEQ ID NO: 502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatggacctgggcaggggacgttggatgct

SEQ ID NO: 503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatggacggtcgcttaacgtcggcctcgcg

SEQ ID NO: 504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgtcgacgtttagacacaggcgtgctta

SEQ ID NO: 505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatgtctgcgaacttacaatagttgcgccc

SEQ ID NO: 506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacattacttaggtcccgtagtgttctgtaat

SEQ ID NO: 507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacattattggacgtgctcatgtgggtcagtg

SEQ ID NO: 508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacattcattgtggtctcttagggaaaagcca

SEQ ID NO: 509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacattcttgcgattcagctaatcattcttcc

SEQ ID NO: 510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacattgttactaaggttagagattcagaatg

SEQ ID NO: 511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatttcgtggttttgggtacaaacggggcg

SEQ ID NO: 512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatttgcggctgcttgcgggtcacccggtc

SEQ ID NO: 513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacatttggtttggggaaggggacctgtatcg

SEQ ID NO: 514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacattttgtattccttacctaggcttagtta

SEQ ID NO: 515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaaatcagtctacgtgtatggttagctag

SEQ ID NO: 516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaacacagtcataaagggatagacataag

SEQ ID NO: 517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaacccgatggcggtgggtcacttgcgat

SEQ ID NO: 518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaaccggttcttattcacattagatccct

SEQ ID NO: 519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaactccggcccgtttcttagcggcaatt

SEQ ID NO: 520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaactcgcagacatgagttgcgtttagcc

SEQ ID NO: 521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaaggtcaggccgcccgagatgccctgtt

SEQ ID NO: 522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaaggtgtatatccaccggagtgatgcca

SEQ ID NO: 523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccacaaacgacgttatgacagtatggtctt

SEQ ID NO: 524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccacaccatcttagaaattcaatgtcatgg

SEQ ID NO: 525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccacagtggaatcagtgggctagccgtgta

SEQ ID NO: 526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccacatacgacaggcatttcctctcgtctc

SEQ ID NO: 527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaccggacgcgcttgcatatcttggaccc

SEQ ID NO: 528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaccggcttatggtattttagtcacctcc

SEQ ID NO: 529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccacgatgtcagcagcactgtagtgatatc

SEQ ID NO: 530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccacgcgcgtgatctgaccggattgcggac

SEQ ID NO: 531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccacgtggtacgtcaggaactctactgcct

SEQ ID NO: 532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccactacacgcgcggcgtaatcgatgtggc

SEQ ID NO: 533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccactgcctccaggattggcgacaagagta

SEQ ID NO: 534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccactgtgcagacgtttgtgtcgctagttg

SEQ ID NO: 535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagacggcatgtgaactcgtaccgtcata

SEQ ID NO: 536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagacggggtgatgtgggcggaagggagg

SEQ ID NO: 537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagactgtaagtgtgcctcgctggaactc

SEQ ID NO: 538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagagtggtcaagccaaagctcgcatcct

SEQ ID NO: 539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagcaccctacgcagccggcgtcagaggc

SEQ ID NO: 540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagcactctctgtcattggagttatcgca

SEQ ID NO: 541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagcttgaattcggccaagtaagtaaccc

SEQ ID NO: 542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagggaagtgtcgacacaggccaggggca

SEQ ID NO: 543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccaggggccggcgtttcacgtcgctagatt

SEQ ID NO: 544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagtacacttaaattcgatcttttgtgcc

SEQ ID NO: 545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagtcaatacaacctttgccgttcgttgg

SEQ ID NO: 546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagtcgcactacatgagccctcggggtcg

SEQ ID NO: 547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccagtgacagtctaatagatgtctcaatcc

SEQ ID NO: 548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccataagccaactggtgcacgccacaccgc

SEQ ID NO: 549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccataccgtgtgactggtttcgcttcgttg

SEQ ID NO: 550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatacgtgcgacaggctcggtcatcccgc

SEQ ID NO: 551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatagcctcatgtaatgaaaccatcgccg

SEQ ID NO: 552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatagcgaactcgatcatgttaagcgagt

SEQ ID NO: 553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatcatttccttttgatgtgatactcaat

SEQ ID NO: 554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatgaccgaatcactgtaatgctaccaat

SEQ ID NO: 555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatgcgtgccattgtgctggcgtcctttc

SEQ ID NO: 556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatgtggggcggttgtgataggtgcgaac

SEQ ID NO: 557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccatttcgattaactcgggtaaccctcggc

SEQ ID NO: 558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccaaagggactcatagctccatcgactca

SEQ ID NO: 559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccaagctcaaaagcgctgatgtgtagaac

SEQ ID NO: 560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccaatggaagggcacggtgcagaacggga

SEQ ID NO: 561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccaggacgaccctcagccgggcgattggc

SEQ ID NO: 562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccaggagatgctctaagacgccacgtgtg

SEQ ID NO: 563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccatcgaagagcaacgaacccggccctgt

SEQ ID NO: 564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccccacatctgccacctgctacaccaggat

SEQ ID NO: 565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccccattgtttcgctgcagtacagtattaa

SEQ ID NO: 566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccccccgacatcgccatctccggtaacaac

SEQ ID NO: 567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccccggacattcagagagtaacccaacta

SEQ ID NO: 568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccccggtaatcttcgcgtcttttacctgct

SEQ ID NO: 569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccccgtatgtgttagcattgtattcctcca

SEQ ID NO: 570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccctcaaggtcgcctcctataagctagcg

SEQ ID NO: 571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccctcattcattcgttaaatgagcagtcg

SEQ ID NO: 572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgaagcctcgatggccatttcctgcatc

SEQ ID NO: 573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgagatttggacttgagacctgacagcc

SEQ ID NO: 574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgagttaggcattcgtagctggtttgga

SEQ ID NO: 575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgcgctcagattcgggaacagtgttgtg

SEQ ID NO: 576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgcggatttggactgaatacgattggag

SEQ ID NO: 577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgggacgagtgttgataggaaggctaag

SEQ ID NO: 578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgggcaagtgtgctctccgatctaccgg

SEQ ID NO: 579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgtcctggcgctgaaggaagagggtggg

SEQ ID NO: 580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgtgagctcaagaggcggccccagtgta

SEQ ID NO: 581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccgttacggcgttgagtttttttgtgccc

SEQ ID NO: 582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccctaggcaagctatctaaacggcgtcacg

SEQ ID NO: 583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccctcaaactctgtgcatcgttgtcctcga

SEQ ID NO: 584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccctgctttttgtgtgagatttccgcgcgt

SEQ ID NO: 585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccctggagatttaacgatttccagtaaaat

SEQ ID NO: 586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccctgggaatcgagtaggacagattagtaa

SEQ ID NO: 587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccctggtcatttggagatatacgaattaac

SEQ ID NO: 588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccttgattatagcttgccactggcactta

SEQ ID NO: 589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacccttgccgagaaacaaggcttttagctcc

SEQ ID NO: 590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgaatccttacgcagaatgtaccaactac

SEQ ID NO: 591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgaatgccgtggagcagttgccactgtat

SEQ ID NO: 592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgacgaatattgccagtgagcagtgcgct

SEQ ID NO: 593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgacgcgcccccaattacccgcctggttg

SEQ ID NO: 594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgagcagggagcgatgagccacaaggcca

SEQ ID NO: 595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgaggtcaggggaatctgtagccacatcg

SEQ ID NO: 596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgatctgacggtgctggtttgtggtgttt

SEQ ID NO: 597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgatgagcagacccgcgttcttttgttcc

SEQ ID NO: 598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgattagtggatggttgtcgctttttctc

SEQ ID NO: 599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcaacccaatctctactgcttccgggta

SEQ ID NO: 600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcactttaccgtcggagcaaccgcgatg

SEQ ID NO: 601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcagcggatagtgtcggccatggcgtcg

SEQ ID NO: 602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcatatggctaaacacgcccactttggt

SEQ ID NO: 603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcattctacctcgcctcgtttgtgatgc

SEQ ID NO: 604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcatttctcgggttaagattgtgattct

SEQ ID NO: 605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcccggaaaccactaggagcatgtgtga

SEQ ID NO: 606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgccctactgatccagggactgtgggaat

SEQ ID NO: 607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcgaacggctcgttgcaatttgggtggt

SEQ ID NO: 608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcgacgatcgactatattccccagctcg

SEQ ID NO: 609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcgcattgggcaacttttcaccacaccg

SEQ ID NO: 610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcgcggatactgcccactatttggcggg

SEQ ID NO: 611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgcgtcctagtgggttagagttttgcgcc

SEQ ID NO: 612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgctaggccgcctcgatgagcttgtctgg

SEQ ID NO: 613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgctgatccaaggtccgacgttttctttg

SEQ ID NO: 614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgctgatcccaaacccacgaggacggcgc

SEQ ID NO: 615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggaaatcttagaccggagatttactagt

SEQ ID NO: 616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggaggtctccagttgaattgtatggcgt

SEQ ID NO: 617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggcagcacgggcacagggtggactacca

SEQ ID NO: 618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggcatcgacgtacataatcacgatacgc

SEQ ID NO: 619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggcccgcggagtcgggtattacgcgtgg

SEQ ID NO: 620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgggagcttcggatctgtgtgagacgatt

SEQ ID NO: 621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgggcgtctacagggatattctatagacg

SEQ ID NO: 622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggggatcgttcgaatgcaggctagttcc

SEQ ID NO: 623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggtacacctcctcagggaattccccgtc

SEQ ID NO: 624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggtcacagagcgtcactagttcaggagc

SEQ ID NO: 625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggtgacgacatgtgcgatcattcgggag

SEQ ID NO: 626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggtgtgctctgttcatcaacgcaaacac

SEQ ID NO: 627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggttaccttcatttaacctgatctcggt

SEQ ID NO: 628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccggttatggctctctgaggaagtttcggg

SEQ ID NO: 629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtaatctaattccgtccgatccttgttt

SEQ ID NO: 630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtacagtgcgccgattcttttatcgtcc

SEQ ID NO: 631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtataaagctggagtgaactactctgga

SEQ ID NO: 632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtatgctccatcgacttgcgtagtatcg

SEQ ID NO: 633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtcggcagccctcgaatcgttcttccaa

SEQ ID NO: 634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtcttgtgcgttgtgcggtgctttaggc

SEQ ID NO: 635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtgggcatgcataacaaccctttgttct

SEQ ID NO: 636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtgtcgtcttggcttgacgctcagctcc

SEQ ID NO: 637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtgtcttgccgtttcgcaggtattgccg

SEQ ID NO: 638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgtgtgccgtgacgccatagcatagtcgg

SEQ ID NO: 639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgttccgaggggaggcggctgactgatac

SEQ ID NO: 640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccgttgcgagctccagtaacatgtctgggg

SEQ ID NO: 641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctacacatcgccgacctaagtgaccattc

SEQ ID NO: 642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctacaggtcgttgatttcctttacagccc

SEQ ID NO: 643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctacttatctaatataaacttttgacaga

SEQ ID NO: 644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctagccaggacaaattcactctttagctg

SEQ ID NO: 645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctagtgacacggagatacgcgtttgtggg

SEQ ID NO: 646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctatcggcgttggacccgggtacgacgtg

SEQ ID NO: 647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctatgtgtccatcgtcgcatgtgtacatg

SEQ ID NO: 648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctcagcgttaatgttggatatactgagcg

SEQ ID NO: 649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctcaggcgatccggtgtcgacgttatgcc

SEQ ID NO: 650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctcaggtagtgctctcgatgcatttgaac

SEQ ID NO: 651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctccagtcttgtacactcagtttaatctt

SEQ ID NO: 652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctcgtggtgatcctgctgatggccgatcc

SEQ ID NO: 653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctctcgattgagggcaagtcgggggcaga

SEQ ID NO: 654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgactagtgattcatctggactagcact

SEQ ID NO: 655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgataacagtcatcatcagcgcagagtc

SEQ ID NO: 656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgcaacactctagccccttttgttagtt

SEQ ID NO: 657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgccatcgattatcacgcagcctttgta

SEQ ID NO: 658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctggggtgttgatcaatcggccagtggac

SEQ ID NO: 659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgggtacgtcaaacccggcactgttcgt

SEQ ID NO: 660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgggtcacagcacatgcattcgtaggac

SEQ ID NO: 661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgggtgttctcgctcgttctcttcagtg

SEQ ID NO: 662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctggtgcaccttttttaccgcccagtggg

SEQ ID NO: 663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgtccagacttaagcgtggtttttcttg

SEQ ID NO: 664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctgtcgtaagtacgtgaatgccgatcatg

SEQ ID NO: 665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccttaggggagcctcgtgcgggaaaagtct

SEQ ID NO: 666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccttatggtacacgcaacagtgaggttggg

SEQ ID NO: 667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccttctcgacgtgggatattgattagcgcg

SEQ ID NO: 668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccttgatgaactcggtgaatcaggtaagtc

SEQ ID NO: 669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccttggattcacaatgtggaagggtagcat

SEQ ID NO: 670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccttgtcgagccaatagctacggcttttgt

SEQ ID NO: 671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaccttgttaaagtcaggatactctgtccgca

SEQ ID NO: 672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctttcgttttaggttatttactgagtctc

SEQ ID NO: 673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctttgaacaaatctgttttcattggtcct

SEQ ID NO: 674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacctttgcaatcacagctgtcagggagcctt

SEQ ID NO: 675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaaaattgtcgagacaagctcctacgacg

SEQ ID NO: 676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaaagttggcctcgtcagtctgctctgga

SEQ ID NO: 677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaacgaaacagctggccgggtattattgg

SEQ ID NO: 678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaacgtagcggaccttgatgggctggtag

SEQ ID NO: 679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaacttaaacttgttctgtccgcggccga

SEQ ID NO: 680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaagaagggatactgtacgccttgttagc

SEQ ID NO: 681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaagagaaggagttttgtggcattcactg

SEQ ID NO: 682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaagatcgtacgcgtatgactcacacccg

SEQ ID NO: 683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaataaccatcccaggactgttttccgtt

SEQ ID NO: 684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaattataaagggtgcactatcacgctcc

SEQ ID NO: 685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgacaaaatgcttcgtatgatgccgacaag

SEQ ID NO: 686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgacccttttgaccgttggcgctgacagta

SEQ ID NO: 687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaccggccttctctcgagcccctttgcac

SEQ ID NO: 688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaccgggcgacattggcctaagggcaatc

SEQ ID NO: 689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgacgagacgttttacgacgattgcagctt

SEQ ID NO: 690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgactaggtattttataaacactcatctcg

SEQ ID NO: 691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgactcatagacaagcaaggactgcctact

SEQ ID NO: 692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgacttcaggcaaagatgcttcacccgggc

SEQ ID NO: 693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgagacatcggtatgttcccaccggccgtg

SEQ ID NO: 694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgagagggacatccaccgctggtgtaggcg

SEQ ID NO: 695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgagagtacgcgaaaggtcagcgcctgggg

SEQ ID NO: 696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgagattcgcattaggacaggtcagagccg

SEQ ID NO: 697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgagcccgggattggatgggggcttatggt

SEQ ID NO: 698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgagcccgttttctgggtcatcttagatcg

SEQ ID NO: 699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaggagctatcaagtcggcaagccggggc

SEQ ID NO: 700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaggttcgtgccgtagattcgcctaagta

SEQ ID NO: 701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgaggttttgtgatcggctatcatacgcta

SEQ ID NO: 702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgagtgtggatgcatcgcctagttgtttcg

SEQ ID NO: 703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgatggaggccttggctactgacagttgac

SEQ ID NO: 704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgatgggaagcggggacgtggagcgacagg

SEQ ID NO: 705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgatgtatccggttcgggtgtggaatatag

SEQ ID NO: 706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgattttctcaccgggtttatgattcggga

SEQ ID NO: 707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaaaaagagcccgggttggactacgttt

SEQ ID NO: 708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaaagctgttgcgggcgcgtcaacgttt

SEQ ID NO: 709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaagaccggggtagtcagatggggtcac

SEQ ID NO: 710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaagggcttaaaaatgaggctcatcagt

SEQ ID NO: 711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaaggtgttagggagtacagtgggaact

SEQ ID NO: 712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaatcccgggacggtggataagtggaga

SEQ ID NO: 713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaatgttttccgtttctgctgttgtgta

SEQ ID NO: 714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcacgtcttgtgatgcactcactggatcg

SEQ ID NO: 715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcactcggaaacacgataacatccccggt

SEQ ID NO: 716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcagcgatgggtcgggcggcttcttcacg

SEQ ID NO: 717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaggacgacgcttagaacaagtggggta

SEQ ID NO: 718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcagggccgttgggatcctcgttggaagc

SEQ ID NO: 719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaggggtcccttgtgccgtgcttaccca

SEQ ID NO: 720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcaggtaggtttatcgttctgccagcagt

SEQ ID NO: 721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcagtccgttctccttaggttgcggcggt

SEQ ID NO: 722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcatgcagacacaatggaaacacttgcat

SEQ ID NO: 723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcatgccgccgctacttggccgccatttg

SEQ ID NO: 724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcattgagtcatggaggtttgccaattgt

SEQ ID NO: 725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccacggtgcttttatttccacgggatcc

SEQ ID NO: 726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccactacggtgtctggctcttggtcaac

SEQ ID NO: 727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccagcacaaaaagccgtggtatttaaac

SEQ ID NO: 728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccatattcccggttcttggtcccgtgtc

SEQ ID NO: 729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccatcggaggcctcttgagaagacgggg

SEQ ID NO: 730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccatgtacggatgttctcggtcattcca

SEQ ID NO: 731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcccattacctgtgcaaggcgtcagctta

SEQ ID NO: 732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccgatacaaatcgtatgctatcttggac

SEQ ID NO: 733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccgcaaatcacgtggcccattcgtgcct

SEQ ID NO: 734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccggaatgtatcgatgatggagagtaat

SEQ ID NO: 735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgccgtatgacacacaaagccgctgagaca

SEQ ID NO: 736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcctaccaaccgagcttgcactaagggcg

SEQ ID NO: 737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcctgaccccgcgaggttgacggggagag

SEQ ID NO: 738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcctgtgcctaccttattccggcgatgcg

SEQ ID NO: 739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcctgttgcctgggaatcgggagacggga

SEQ ID NO: 740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgacctcagttaactctagcgggcgtgc

SEQ ID NO: 741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgactgatccactatagcgtccttcagc

SEQ ID NO: 742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgagacgtagggggcaacgagggctgag

SEQ ID NO: 743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgatcttagtttagaattgttgatcact

SEQ ID NO: 744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgcaagggaaattgccacggttgcagag

SEQ ID NO: 745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgcagagaaacgctgctcaccgtccggc

SEQ ID NO: 746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgcagtaacggggcgacagggatttgtc

SEQ ID NO: 747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgcccccgcacgggtattaaagtcgctg

SEQ ID NO: 748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgcgccaagcttcccctcccccgatgta

SEQ ID NO: 749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgcggatattgttatgttagcattcatg

SEQ ID NO: 750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgctggcaggtggcagggaccctaacac

SEQ ID NO: 751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgctggggtaggggagggacatccatcg

SEQ ID NO: 752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgcttcggtgtgatgtgtcttgttgacc

SEQ ID NO: 753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcggatcaagaatgcctgaccgaactaag

SEQ ID NO: 754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgggctacagattatgagtattacattg

SEQ ID NO: 755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcggtaatagcttcattcagtgtagatcg

SEQ ID NO: 756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcggtgtgcgccggtggttttcttcgcgg

SEQ ID NO: 757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgtagggtagctttgagacatgcgggga

SEQ ID NO: 758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgtcctattcgaagtcaggcttacgcgg

SEQ ID NO: 759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgtcgatttgcctggtcttgatgcggca

SEQ ID NO: 760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgtcggcagttcggctggtaaccacttg

SEQ ID NO: 761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgtcgggatggcattgtaaggaacacgc

SEQ ID NO: 762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgtcttcatacgatgttgtgaatgttgc

SEQ ID NO: 763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcgtttcgtatcgtgtatgtgatagctgg

SEQ ID NO: 764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctaaagttacgggcaagctaatgtgtag

SEQ ID NO: 765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctactgtaaggaaagtccgtaagcctgt

SEQ ID NO: 766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctagcatttatcggcgattgtggctgta

SEQ ID NO: 767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctccgggatgagcagggtgagactgggc

SEQ ID NO: 768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctgacactgacgggtgggatggagtact

SEQ ID NO: 769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctgacaggctcaaaaaggaagggcctat

SEQ ID NO: 770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctgctagtggactgcatgaatggccggc

SEQ ID NO: 771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcttaacctccattacagacccggaccgt

SEQ ID NO: 772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcttagtgtccgtccagagaggggctgtc

SEQ ID NO: 773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcttctcccgcggtatgtgcacttcgagc

SEQ ID NO: 774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcttgcggcaggctggggagtatcgccaa

SEQ ID NO: 775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcttgttttgtaacgtctggtttaggtgt

SEQ ID NO: 776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgctttatccaaatccttttcgtatctgcc

SEQ ID NO: 777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgcttttaagtctgcctgctggaccgtatt

SEQ ID NO: 778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggaaaggcatatttacacctcagcgatct

SEQ ID NO: 779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggaacaggttgtctgcttgatcgcggtgc

SEQ ID NO: 780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggaagacaacgctcgggtttacggccgga

SEQ ID NO: 781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggaatgtcgtggttctgggggttgtgatt

SEQ ID NO: 782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggaattgagaaattgacaagtcgaagctt

SEQ ID NO: 783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggaattgcgaggtcgagagtccgcacact

SEQ ID NO: 784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggacaattagctttttgcgtactggaccc

SEQ ID NO: 785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggacgattacgtcgaagtggcagcacagt

SEQ ID NO: 786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggacggttgagtgaggtgagacgttctcg

SEQ ID NO: 787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggagaaggcctcgatcttccacccaacgc

SEQ ID NO: 788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggagagacgtcaaggtgcaatgcgccgtg

SEQ ID NO: 789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggagagagcaccaagcgtcgcaatggggc

SEQ ID NO: 790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggagtcaggggtgatttggtcctccgcac

SEQ ID NO: 791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggatgagagaggacctgcgatgttctcac

SEQ ID NO: 792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggattacagcagcggattcatgttgtata

SEQ ID NO: 793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggattggaagtctcgttgccgttttggca

SEQ ID NO: 794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcaccaattttcggacgtggaatcgcaa

SEQ ID NO: 795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcaccacggctatatctttctcgaagag

SEQ ID NO: 796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcacgaatggttgtttcctacaaacgat

SEQ ID NO: 797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcacgggagagacaggtgtgcgacgtag

SEQ ID NO: 798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcataacacgagtgttttacccgtcgtc

SEQ ID NO: 799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcatctgtgctacaatggtttcgatcgg

SEQ ID NO: 800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggccacaaccctgcgtcgattctacagtt

SEQ ID NO: 801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggccatttgcttacgttggccccttggct

SEQ ID NO: 802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggccgaggcagtacgaccactgcgagatg

SEQ ID NO: 803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggccgatcggtgatggatatgccttaggg

SEQ ID NO: 804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcctcgaggattcccctaactggtagcc

SEQ ID NO: 805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcctggcctagcgctgcctggagccctt

SEQ ID NO: 806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcgaggggatcttaccgaccgcacacct

SEQ ID NO: 807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcgaggtgtctttctaccagtgcgactc

SEQ ID NO: 808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcgctcggcaagcgggctacatctacat

SEQ ID NO: 809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcgggtaagcacagtcggtagcgtagcg

SEQ ID NO: 810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcggtcgcccccgataacgcagttaaga

SEQ ID NO: 811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcggtgtggttgtaaattggaaagcatg

SEQ ID NO: 812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggcgtcagtccaaatgtcacatctggcac

SEQ ID NO: 813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggctatgctatcgggtgaacatcactgtg

SEQ ID NO: 814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggctcagtaggtgacttatgtagctccca

SEQ ID NO: 815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggctcgccgcatggcgcgtgtcatcaggt

SEQ ID NO: 816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggctgccaagcggttggcgtgatgggttc

SEQ ID NO: 817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggctttgtcgaaggaacgcgaagggaagt

SEQ ID NO: 818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggaatctgtcatatacgatcaatcctgc

SEQ ID NO: 819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggagccgcggtgtatgcccgaggaccga

SEQ ID NO: 820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggaggtcctacacatatgtaatggtggc

SEQ ID NO: 821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggatcccaattggagttataattacgat

SEQ ID NO: 822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggcagtacgacttcatgatgagctgctg

SEQ ID NO: 823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggccgcgtgcgccggaataggttccatt

SEQ ID NO: 824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggcctaaaactgtctgtttcttacgtgg

SEQ ID NO: 825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggcgcataggatgcaaaggcccacaggc

SEQ ID NO: 826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggcgcgtacattaacgaatcggcgctat

SEQ ID NO: 827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggcgtaggggaaggggacgaaagcggcg

SEQ ID NO: 828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggcgtgatgttttagccgttttagcccc

SEQ ID NO: 829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggcgttatggagggcagggctcccgttc

SEQ ID NO: 830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggctgtctgtgcgcagtgtttgggacgg

SEQ ID NO: 831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggggctgcgaatcatagcggtgaatcgtc

SEQ ID NO: 832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggggaagtacggacgtcggtgtacacgt

SEQ ID NO: 833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggggctgcagagtagacctcccaagggt

SEQ ID NO: 834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggggttttccatatctcgtcttactcgt

SEQ ID NO: 835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggggttgtatgagcaaactgctacagggt

SEQ ID NO: 836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggtacctattcgtcgggaaagtcacatg

SEQ ID NO: 837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgggtccggccacaaactacttccgcgaga

SEQ ID NO: 838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtaaaagttcgaacgtgttgtgccggag

SEQ ID NO: 839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtacggcggggttggttatttggctttg

SEQ ID NO: 840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtagcgtatgtttggctataattatgac

SEQ ID NO: 841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtcataacttagtaattgaggtaacggg

SEQ ID NO: 842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtcctaaaccgctacattaccctgtggg

SEQ ID NO: 843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtcttatcccatgctgttatgaggcgaa

SEQ ID NO: 844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtgaaaggtcttctgccacaaacgcgat

SEQ ID NO: 845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtgacaatccgaacacatgttttaggct

SEQ ID NO: 846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtgattctattgctgggcgactccgaaa

SEQ ID NO: 847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtgcacgatcatttcgatctggccgggg

SEQ ID NO: 848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtgcaggactgcttgggcttatggaccc

SEQ ID NO: 849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtggacccgagacaacacacaaatgtgc

SEQ ID NO: 850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtggcgatgattattctgctagatgggc

SEQ ID NO: 851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacggtgtttgcagccgggatgacgttcgctc

SEQ ID NO: 852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtaagtcgggtcattcgcgatcgggacgg

SEQ ID NO: 853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtacagcctgttccgtgctgcccggtgtt

SEQ ID NO: 854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtaccatggcgagaaagcgggcgttggga

SEQ ID NO: 855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtagcccagtgatgatttaggtccggccc

SEQ ID NO: 856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtaggggagattagggcatataatagcgg

SEQ ID NO: 857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtagtatggattttcagactcatcgaagt

SEQ ID NO: 858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtagtgttaacgtcatcaaggttaactga

SEQ ID NO: 859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtatatgcgctccaatggcaacagccttt

SEQ ID NO: 860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtcaatgcctcctcgtcgtcagtgattaa

SEQ ID NO: 861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtcccctgcatccaacgtgatctactagg

SEQ ID NO: 862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtcccgctcacccttaggcgcgcccggtg

SEQ ID NO: 863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtcgacccaggaagttagtgtcagccatt

SEQ ID NO: 864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtctcacacctcttatcgcggaggtcttg

SEQ ID NO: 865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgaccaaaacagtttttatctgttggcg

SEQ ID NO: 866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgacgggtaactaacacaggtacgtctg

SEQ ID NO: 867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgagagtggttagtggatagtctcggag

SEQ ID NO: 868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgaggttccctctacccgaagcatgtcc

SEQ ID NO: 869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgataacgcatacgtggcctggggtgtt

SEQ ID NO: 870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgcaaagcggggactggcaggcgcgccg

SEQ ID NO: 871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtggatcaaccgttccaccatcggatggt

SEQ ID NO: 872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtggattgtgtttaacaggtatgggcatc

SEQ ID NO: 873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgtagcatggaggaggcgttgtcgctca

SEQ ID NO: 874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgtccatttcctactgccgtgttgcggg

SEQ ID NO: 875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgtgactcttgctttgggccgcatatag

SEQ ID NO: 876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgtggatcttgaatttgtctgtcaggcc

SEQ ID NO: 877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgtgtacttgcggggtctgaacataagt

SEQ ID NO: 878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtgttggggtcactactcattagtgtaga

SEQ ID NO: 879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttacgcctctgattgctttacgacctaa

SEQ ID NO: 880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttacggtgatgcgtcacgctaatcggtc

SEQ ID NO: 881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttagagggcgctcggttgtcagcctagg

SEQ ID NO: 882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttatctgattcattttcctgtatcgtct

SEQ ID NO: 883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttattgttttgcttgaatcatataactt

SEQ ID NO: 884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttcggtcacgcctaaggttgtttaaatt

SEQ ID NO: 885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttctttggacgtgactcctagccattcc

SEQ ID NO: 886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttggtctgggtacgttgggtacacccgc

SEQ ID NO: 887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttggtgtgggctctatggaactgcttcg

SEQ ID NO: 888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtttcctgatcttggtagccgctcgtcgg

SEQ ID NO: 889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgtttgtaccggactctagttaatatttct

SEQ ID NO: 890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacgttttggtggctgttatgagtgcctcccg

SEQ ID NO: 891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactaaacgttttctgaaggtcgtcacgctcc

SEQ ID NO: 892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactaagcaagtagagcctgtaaactataatg

SEQ ID NO: 893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactacaaatctgtcatctcttcatcttgcac

SEQ ID NO: 894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactacatcggcagttcgtgggggcaccggtg

SEQ ID NO: 895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactaccagggatccggaatttgctttgatta

SEQ ID NO: 896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactacccatgccgttcatcggagagtgggct

SEQ ID NO: 897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactacctttgtccgagaccgtgtggttctgt

SEQ ID NO: 898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactacgaggcccggacagctcggggctgtgt

SEQ ID NO: 899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactacgcgcacatcagctcgatcgtctccgg

SEQ ID NO: 900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactactagaaataaccgtataggggaatctg

SEQ ID NO: 901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactagcaatcaacacgctaacaccttcgggg

SEQ ID NO: 902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactagccagagccgacagctttaggcccagt

SEQ ID NO: 903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactagggctcattgatcgttgacgcgctccg

SEQ ID NO: 904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactagtctgttaaaggtaagagtgcctgtgg

SEQ ID NO: 905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactatctgttgcacatgatggttatgacatc

SEQ ID NO: 906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactatgtacgatccgggagtctttgtatatg

SEQ ID NO: 907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactattcgggacttgcggaccagttcgggga

SEQ ID NO: 908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactattgacgattagctattctagcgacttc

SEQ ID NO: 909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcaacgatgtgctcggccgatgtcggcgt

SEQ ID NO: 910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcaacgtattttaaaatggagggcagatt

SEQ ID NO: 911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcaagtgttgtgctttggtcgtggccggg

SEQ ID NO: 912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcaatggcagggtgtcgctactgtgtcgt

SEQ ID NO: 913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcacgcggatggtacaggtccaacaacga

SEQ ID NO: 914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcactaagccagtagtagtggcgcagcat

SEQ ID NO: 915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcaggcttggtcggcctgcgtgtatagtt

SEQ ID NO: 916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcatggcacgactctgttgcttgccacgc

SEQ ID NO: 917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactccaacacttaacaggtgcgcgtgctaag

SEQ ID NO: 918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactccacgttagtgtagggttccggtgaggc

SEQ ID NO: 919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactccgatgttgctgtggcagttttcgaaac

SEQ ID NO: 920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactccggatgtgctagactctggggatcaga

SEQ ID NO: 921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcctcgcggtcacggcctctgtatctctc

SEQ ID NO: 922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcctgatttatgtgtgtcgcgtgccttgt

SEQ ID NO: 923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcgaaagtggagacacgcttcctggacgc

SEQ ID NO: 924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcgaccgttctgtgtgcgagaacttggcg

SEQ ID NO: 925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcggcatatgatgactcggtccgggggcg

SEQ ID NO: 926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcggcatgacttggagtctcatgtgtccc

SEQ ID NO: 927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcggctaagaaataccggccttttgcggg

SEQ ID NO: 928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcggtggccccgaggactcctgtaggttt

SEQ ID NO: 929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcgtaagctgtgttataaaggtcctgcgc

SEQ ID NO: 930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcgtcggtgagaaagattggcctctgatc

SEQ ID NO: 931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcgtcttaccctggcgtgaaaggataagg

SEQ ID NO: 932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcgtggtctgtggtaaggagattggcttt

SEQ ID NO: 933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctatcccactttcctccttcaatcgtct

SEQ ID NO: 934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctatcggaccgatttatcgcaatcggag

SEQ ID NO: 935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctatgtgcgcacgtggctgggaccgatt

SEQ ID NO: 936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctcaaagtaggcaggttgttctgtacca

SEQ ID NO: 937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctcccgctcggaaaacgcgcatctcatc

SEQ ID NO: 938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctcccgtattggtgctcccaaattggcg

SEQ ID NO: 939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctggccgaacggggtacgagtcctcgac

SEQ ID NO: 940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctgggggcgacaggatggtgggtgtcat

SEQ ID NO: 941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctggttaagccatttctggagacgtgtt

SEQ ID NO: 942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctgtcacgtggttgtagaggagcgcctg

SEQ ID NO: 943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctgtgattctcgctaaaacaggctccta

SEQ ID NO: 944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcttctggctcaatttctgcatgctgcac

SEQ ID NO: 945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactcttgccgtgccttggcgtacattgacga

SEQ ID NO: 946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactctttgctcggaccggcataaagttacac

SEQ ID NO: 947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgaatggtcgaattagattccggcgttgc

SEQ ID NO: 948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgactgcgttggcaaactactgaacccgg

SEQ ID NO: 949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgagccggctgcgatcgctttattaatgt

SEQ ID NO: 950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgcaaccttggaggtgtctgtgcggcttc

SEQ ID NO: 951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgcactccagcggcaaagacaacgcctgc

SEQ ID NO: 952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgcaggccccgcgtacggattgtgatatc

SEQ ID NO: 953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgcatggagcggacaggagatatttgtct

SEQ ID NO: 954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgcatgttcgggatgctctcatgtgcctt

SEQ ID NO: 955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgcgctaagtaggtgctgcgacaagtggg

SEQ ID NO: 956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgctccaagatcgttcgagtcggccatcg

SEQ ID NO: 957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgctgagcttaaacaatgtctgggacaca

SEQ ID NO: 958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggaaagggtcacgagacacggctacagg

SEQ ID NO: 959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggaactcgcgtgtcgcgggggacttacc

SEQ ID NO: 960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggacgtacgtctgcagcctcgccgtcca

SEQ ID NO: 961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggatcgtaaaggtcgtggcggctaaacg

SEQ ID NO: 962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggatgcgcaaggccgtgattaatgtctt

SEQ ID NO: 963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggcaagcttaatcttgaaactctgagct

SEQ ID NO: 964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggcgcatatgacgtcaatgagtgctctc

SEQ ID NO: 965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggctcacgtcgtgtttaacgccagggag

SEQ ID NO: 966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggcttggtactcgaggatgctttggttc

SEQ ID NO: 967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggggcgtgcctattcttggattctgccc

SEQ ID NO: 968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggtagacgatgtggttctgttaccgctc

SEQ ID NO: 969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggtatggcttcattccgcgccgttcgta

SEQ ID NO: 970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggtcagggtgattaccggaagagctgtg

SEQ ID NO: 971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggtctaatgtgggatgcgtgcccgttgt

SEQ ID NO: 972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggtgcattttatgggaggtgatcaaggg

SEQ ID NO: 973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactggttataaggcgagtgtcggtcacgcgg

SEQ ID NO: 974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtaatcggggttcacgggctgttccaac

SEQ ID NO: 975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtacgcgggtcaacatgtggcttcggag

SEQ ID NO: 976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtatcactttgagacccgaggatgcttg

SEQ ID NO: 977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtgaagcgaaatcgagctggggtgcatc

SEQ ID NO: 978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtgctagtatgacgtactgacacgtccc

SEQ ID NO: 979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtgggaatctcgcctatgtaatggcacc

SEQ ID NO: 980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgttgcaatattgtcatactacagtggtg

SEQ ID NO: 981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgttgggcagagacttactggattctggt

SEQ ID NO: 982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtttagtatcgttgtttgtgtctcggcg

SEQ ID NO: 983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactgtttggggacaagatggaccgacattct

SEQ ID NO: 984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttaacggtgtatggcccctataaggaggc

SEQ ID NO: 985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttactcgtcatgtttaggtagtcttgcgt

SEQ ID NO: 986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttaggttttttaactcgaccgggggcgag

SEQ ID NO: 987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttatcctgtgaagcagaggtggcgtgaca

SEQ ID NO: 988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttcacctacttggtgtcacgatggcatcc

SEQ ID NO: 989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttcatcaccgtagagttggaccaatcttg

SEQ ID NO: 990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttccgctgaaatgaccgtgtcagctcagg

SEQ ID NO: 991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttccttgtgggttcggtcggccagtgggg

SEQ ID NO: 992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttctcgttcttggtttgaacagtgctggg

SEQ ID NO: 993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttgaccagtgttctggttgttgattgaca

SEQ ID NO: 994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttgatgcgggtattgctctagtcgggtgc

SEQ ID NO: 995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttgcgcacgaccgatctcatctcgtatcc

SEQ ID NO: 996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttgcttgtcaattatcgcgagctatagca

SEQ ID NO: 997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttggctccccttccgttccactgagtact

SEQ ID NO: 998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttggtagaacctggcgctgacagtagcgg

SEQ ID NO: 999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttggtagttaatgaataagtgtaggtctg

SEQ ID NO: 1000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttgtagagggttacgaggggttgttgcgt

SEQ ID NO: 1001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttgtaggacactatatcgtttatgaggtg

SEQ ID NO: 1002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aacttgttcggccgccagtccccgcttgtgtc

SEQ ID NO: 1003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactttaaaggcgatcgattcttgcccgacgg

SEQ ID NO: 1004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactttactgtcggtgaccgtgttgcacaggt

SEQ ID NO: 1005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactttattaggactagttcgtgggggctaca

SEQ ID NO: 1006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactttcgtagagtttatgtgggaggcgatgg

SEQ ID NO: 1007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aactttgcaactcatgtgcttgtgctggtggc

SEQ ID NO: 1008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaaaaacgtgcgtatccacttgcccagatg

SEQ ID NO: 1009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaaacaaggtagtctccatttatgccccgg

SEQ ID NO: 1010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaaacaggctggattagcttgaccgagctc

SEQ ID NO: 1011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaaagcgaaacacgggatcggtagttagat

SEQ ID NO: 1012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaaaggaacgtgtggattggacgtcgctgc

SEQ ID NO: 1013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaacaactcacgtgactgccatcgctgtag

SEQ ID NO: 1014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaacaggtgatcattgcgtctctgggaccg

SEQ ID NO: 1015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaacatcatgggagaccaaggacttaaagc

SEQ ID NO: 1016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaacattctgggtcgttgagttttcagcca

SEQ ID NO: 1017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaacctgtctaagaaggtccatgtccaggg

SEQ ID NO: 1018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaacgaccaaattctgcctatgttccgggc

SEQ ID NO: 1019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaacgtgtatggtgaagacagttccgtgac

SEQ ID NO: 1020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaagagttctatttgaagtatctcaggacg

SEQ ID NO: 1021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaagccgaccaactccaacggtacaagggt

SEQ ID NO: 1022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaagcgtctatcacgccggcaggatgttcg

SEQ ID NO: 1023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaagctgttgtgcatagttacctaaccgcc

SEQ ID NO: 1024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaaggctttctcgtggtaatttattatatg

SEQ ID NO: 1025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaagggttctccacacatgctgtaacaggg

SEQ ID NO: 1026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaagtctttgtaatcacgggccccgcgcgg

SEQ ID NO: 1027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaagttggtttacgcacgatgtcagtgctt

SEQ ID NO: 1028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaataagccttgtgctacgttgcgtaaccc

SEQ ID NO: 1029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaatagcgcccctcattaactagatcggct

SEQ ID NO: 1030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaatagcttgcaaacggtgcaccttaccgt

SEQ ID NO: 1031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaatcgcccggatttagggatgtgcttacc

SEQ ID NO: 1032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaatgcgggtgtaaccattattggaccata

SEQ ID NO: 1033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaattgagcaatttgtcgaggcctatcggt

SEQ ID NO: 1034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaatttgcgagttgatctcacgcgttatat

SEQ ID NO: 1035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacaaccagttttatacgtggctgcgtgag

SEQ ID NO: 1036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacaccagcaaattcaaagccatcgacttc

SEQ ID NO: 1037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacaccgtcacgtagcatggaacacgttag

SEQ ID NO: 1038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacactgctgcacgattcgcctttgggctc

SEQ ID NO: 1039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacagatggcctgcccggtggaccttgtcg

SEQ ID NO: 1040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacaggactcgatgtgtctcgttctgctag

SEQ ID NO: 1041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacaggcacgcatcgcttacttgctttatt

SEQ ID NO: 1042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacaggcgtgctatactggtggggcaactc

SEQ ID NO: 1043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacagggacgtcggatgctatcgcgtaggg

SEQ ID NO: 1044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacagtagtttgcagcgttccgtttccatc

SEQ ID NO: 1045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaccatggcaattagcagatggtttgcatg

SEQ ID NO: 1046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacccgatgtgagcgggatttgttggaggg

SEQ ID NO: 1047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacccgcatcactaagatacatcgattttc

SEQ ID NO: 1048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacccggagcttgcgaagtcgggctctttg

SEQ ID NO: 1049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaccgcatcagcacttagcagcatccggca

SEQ ID NO: 1050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaccggtcccacgtttgagcttacccatga

SEQ ID NO: 1051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaccgttagtgctgaatgtgtggtgcatag

SEQ ID NO: 1052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgacgtattggcatacacgttaggcatg

SEQ ID NO: 1053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgactggctggaaatatacggggcttca

SEQ ID NO: 1054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgccgctaggacagcactgaaggtattg

SEQ ID NO: 1055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgcctctattagatgctccaaggcccca

SEQ ID NO: 1056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgcctttcattgaatctccgtaagcgtt

SEQ ID NO: 1057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgcgtgggtatggaacgaatgccggcgg

SEQ ID NO: 1058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacggcgagttgaaattgctgcacacgatg

SEQ ID NO: 1059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgggccagacgtctgtagcggtaacccg

SEQ ID NO: 1060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgtctatttcttatcatcgccaaagtcg

SEQ ID NO: 1061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacgtgccagcggagactgttctcgcaacc

SEQ ID NO: 1062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagactctacttaatttcggtaagcaactaat

SEQ ID NO: 1063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagactcttaacatgtatcatcgcaataattg

SEQ ID NO: 1064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacttaagtgatcctcagatcttggtaccg

SEQ ID NO: 1065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagacttacggtgcaagttgtttgcgcgggat

SEQ ID NO: 1066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagactttatatagcttgctggacgatcgtgt

SEQ ID NO: 1067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagacgatgcgagactacgcagcgtcgtcg

SEQ ID NO: 1068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagagactgaattgagaatggtaagcatta

SEQ ID NO: 1069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagatcttgtttttgcctctgcaagggtaa

SEQ ID NO: 1070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagatgagcgccgatgtgatgctagtagcg

SEQ ID NO: 1071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagcaccggaagtccattggaaattacgcc

SEQ ID NO: 1072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagcatgcggggacccggctcaagcgcaca

SEQ ID NO: 1073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagccaacgtctgttatgaccgcttgattt

SEQ ID NO: 1074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagccgacacgaaattggggttggcctgtc

SEQ ID NO: 1075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagccgtagaaagggggtcggtcgtctcta

SEQ ID NO: 1076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagctgcggcgggatctaggagacacccgg

SEQ ID NO: 1077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagctgggttagccttgtgccgcccgcctg

SEQ ID NO: 1078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggataagcatactcggcaggttcacgga

SEQ ID NO: 1079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggatggcccggcttcacgtcttcacgtc

SEQ ID NO: 1080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggcggtcgtttagtgttacacataactc

SEQ ID NO: 1081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggcggttcttgtaggttcggatgcagaa

SEQ ID NO: 1082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagggcatacgtttcaatgttatgtcgcgt

SEQ ID NO: 1083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagggctcgaatccactctgcgggccacgt

SEQ ID NO: 1084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggggtgcgcacggtttctttgctcgcgc

SEQ ID NO: 1085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagggtcattcgaaagtgtgggcggggagg

SEQ ID NO: 1086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagggttgacagaacagcatcgactcacct

SEQ ID NO: 1087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagggtttggcacgtgtctccgcctttcaa

SEQ ID NO: 1088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggtaattagattctcagtagttgatttg

SEQ ID NO: 1089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggtccccttgtacccccggccgcactgg

SEQ ID NO: 1090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagaggtgccttctgagcgggacaaaaccgtc

SEQ ID NO: 1091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagtaatactctaatcactgcccgctgttg

SEQ ID NO: 1092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagtcaccaatcagtgagattcacttaagc

SEQ ID NO: 1093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagtcatttttgccctttggcggcgcaagg

SEQ ID NO: 1094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagtgtgagggttggcataacagcgcggtg

SEQ ID NO: 1095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagtgtggtccgtaggtgccatgcccgagt

SEQ ID NO: 1096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagagttgagctcgcttggcacaccgtcggcc

SEQ ID NO: 1097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagataactaagaaattagacagctacgcaga

SEQ ID NO: 1098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagataagagaactcattattatgggtggtac

SEQ ID NO: 1099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagataagcaccgggaggctgcaccatacggg

SEQ ID NO: 1100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagataatacccgcgtacgaccctttgtaact

SEQ ID NO: 1101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagataatccggcgcgtttttggggagagcta

SEQ ID NO: 1102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagataccttcgcttagttcgttattaaagct

SEQ ID NO: 1103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatactaattaggagcttcgcaacgagtcg

SEQ ID NO: 1104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatagatgggtctacatgacgtcggctggt

SEQ ID NO: 1105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatcaagtatctcgctagttcgagcccgag

SEQ ID NO: 1106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatcacatcaccaactggattcttgatcgt

SEQ ID NO: 1107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatccccgggtgttacatcgcctgtcgtta

SEQ ID NO: 1108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatcgcaccaccagagagccgcgtacggac

SEQ ID NO: 1109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatcgtcatttgctgttcagtaggctcacc

SEQ ID NO: 1110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatcgtcttatgctcttgccgctgggtgga

SEQ ID NO: 1111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatctaagctaacgttacacttatgcgtcg

SEQ ID NO: 1112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatctccatggttatgtgacagcgtttggg

SEQ ID NO: 1113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatgacaccgttttcgggaaaaggggaagc

SEQ ID NO: 1114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatgaggtaaccgcagtgtctatatggtgg

SEQ ID NO: 1115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatgggcaggttctatctggataattaccg

SEQ ID NO: 1116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatgtgtgcacgggtgaggtggtattttcg

SEQ ID NO: 1117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagattagggccgacggtcttgtttgttgtgg

SEQ ID NO: 1118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagattcccatatcgtcggcaataacacgtat

SEQ ID NO: 1119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagattcggacacgacgctaatcccgcctgtt

SEQ ID NO: 1120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagattgcgtcaggcagcgttcagggtccagt

SEQ ID NO: 1121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagattgctcagcgacgcagtcttatggcgta

SEQ ID NO: 1122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagattggcccggcggcattgggaacctctcg

SEQ ID NO: 1123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatttcggggtttcgtattcgcgatccaag

SEQ ID NO: 1124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagatttcttgttttaaggccctcaggtattg

SEQ ID NO: 1125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaaaagggtccttcgccctcagcggttcg

SEQ ID NO: 1126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaaccccttttggtcgtaccctgacggaa

SEQ ID NO: 1127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaaggggagtctatgcgaggtggatctgg

SEQ ID NO: 1128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaagtaccggaccattatcaggaaaggtc

SEQ ID NO: 1129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaatccctaagaacgggctacgtgggtca

SEQ ID NO: 1130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaatcgtccacgtagggttccatccacta

SEQ ID NO: 1131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaatggaacgcccgggagtgtgtctccta

SEQ ID NO: 1132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaattatcttaggtcccgataagcgcacg

SEQ ID NO: 1133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaattttccatttaatatcgaaatggggt

SEQ ID NO: 1134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcacaagttgcacttacgtgtatagacttt

SEQ ID NO: 1135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcacaccatcgcgtggggaagccggggtgc

SEQ ID NO: 1136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcacactcgatgatccatgctgaacgtgag

SEQ ID NO: 1137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaccaaatcgatgttatgtacaatacagg

SEQ ID NO: 1138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaccacgacgctttcacagggagcgctga

SEQ ID NO: 1139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaccatagctatgtgcagtactgcagttc

SEQ ID NO: 1140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcaccgcgccagtcttcgtgcccgtgtttg

SEQ ID NO: 1141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcacctccgaacgctacgtgcattaccccg

SEQ ID NO: 1142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcacgctcgaaaagttcccttttagtgtcg

SEQ ID NO: 1143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcactccggttcaggtcgtaccctgtattc

SEQ ID NO: 1144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcactgcgtctttgtttactacgcttttgc

SEQ ID NO: 1145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcacttgcgcccggcccatcgacggattat

SEQ ID NO: 1146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagaaaagtaaaagatcgccttatttaga

SEQ ID NO: 1147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagaagcacacaagcttaaactctcgtgg

SEQ ID NO: 1148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagaagcccgtctggacatgtagacgatt

SEQ ID NO: 1149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagaatggtggtccttttttgtcagcgcc

SEQ ID NO: 1150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagcactaggttgagtgatattcgccttg

SEQ ID NO: 1151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagcggtcgtcaggtaacctgcagggggg

SEQ ID NO: 1152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagcggtgagccacgttaaacgtgccaag

SEQ ID NO: 1153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagctcgctgtggggtaacgattgcccgc

SEQ ID NO: 1154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagggcgtggactgtgttgtaggttcatt

SEQ ID NO: 1155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagtggcctgatgtttataagggatgcaa

SEQ ID NO: 1156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagtgtgcgtcctcccgttctttcttctg

SEQ ID NO: 1157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagttaaattgtatagaggagagggccga

SEQ ID NO: 1158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcagttgactcggctcagggccttccggct

SEQ ID NO: 1159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcatacggctcgttacatcgagtcgtgctc

SEQ ID NO: 1160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcatcggcgagggcgacaactccgaacgga

SEQ ID NO: 1161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcatgaacgatgccgaggggagcgtcgatg

SEQ ID NO: 1162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcatgatgacttaatcggaaccgtggtgac

SEQ ID NO: 1163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcatgttgccccttatatgagtttttgtca

SEQ ID NO: 1164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcattttctgttaacaaattctgaggttct

SEQ ID NO: 1165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccaaccgttcaagtgaatgtacccccaca

SEQ ID NO: 1166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccacaatcggtaagcttggcacagctgtt

SEQ ID NO: 1167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccaccaaaggggtcagtgaagctcactgt

SEQ ID NO: 1168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccacgacatgtttgtccttgcacgaactt

SEQ ID NO: 1169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccagagagggcgagtgtgcaaatccgcat

SEQ ID NO: 1170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccagttggacatcccgaggggaatgcgtc

SEQ ID NO: 1171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccatgagcgtgtgcgtcatagatgcgcgt

SEQ ID NO: 1172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcccagttctcatgtcctgctagcttgttg

SEQ ID NO: 1173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccccaacaaatggcagccctagctcaatc

SEQ ID NO: 1174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccccaagtagtacgtttagggatcgtggc

SEQ ID NO: 1175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcccgcacaacaaaggactcgtagcaaagc

SEQ ID NO: 1176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcccgcttggtatggcagtcgtcgagggtg

SEQ ID NO: 1177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcccgttttaggataaataggaattacatt

SEQ ID NO: 1178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccctagttctcggcaagcggccagtgcgt

SEQ ID NO: 1179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccctgaatccctcacatttatatcggata

SEQ ID NO: 1180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccctgatgattcctgatgtctgtcttcgg

SEQ ID NO: 1181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcccttatttgcgtatcgtacttaactagt

SEQ ID NO: 1182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccgacccctggtgttggtattcgtacagc

SEQ ID NO: 1183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccgagaagcgccgtcggagaggggaggga

SEQ ID NO: 1184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccgctggactccgtgcatccggaggtcga

SEQ ID NO: 1185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccggaggaaacattggctcggacggtggc

SEQ ID NO: 1186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccggcgtttaccgtagcaacaggggcttt

SEQ ID NO: 1187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccggcttaggtccgggatcagcttcatcc

SEQ ID NO: 1188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccggttgaaatctgtgtctatcgttcatt

SEQ ID NO: 1189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccgtgcacagtccccaaggcatatgatac

SEQ ID NO: 1190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccgtgccgcccaactaccaacgcgcgatg

SEQ ID NO: 1191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccgttattagcgctgatttcagttcgggt

SEQ ID NO: 1192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcctaccaagaaaaatggttcataggtagt

SEQ ID NO: 1193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcctaggtagctacgttccagacttctccc

SEQ ID NO: 1194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcctcttcgttgcggatttgaggggtcgag

SEQ ID NO: 1195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccttcagcaatttgctggtgcggttctgc

SEQ ID NO: 1196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagccttccgacctttcattccatacggcctg

SEQ ID NO: 1197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcctttaagcgattcatatggtctcacacg

SEQ ID NO: 1198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgaaggcagagtgtcgcaagagtggctgt

SEQ ID NO: 1199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgacacgatacgcttgtatttggcagaac

SEQ ID NO: 1200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgacgaacctgtacacgtgtaactcgccg

SEQ ID NO: 1201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgactctcgcgcggggccctcgtggtatt

SEQ ID NO: 1202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgagacataccgccccattggtcgtcatg

SEQ ID NO: 1203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgagtggacggtgtgggatgggttgcttc

SEQ ID NO: 1204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgcagtaatccactttaggccttactttc

SEQ ID NO: 1205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgcatcggggtcgggtgcggctatggccc

SEQ ID NO: 1206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgcctaggatttaggatgtatgccaacca

SEQ ID NO: 1207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgcggtagtttgtcatgggatggtaattg

SEQ ID NO: 1208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgctagtctggctgctagtgttaaatttg

SEQ ID NO: 1209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgctcgtgtatccagctaccgaccacgca

SEQ ID NO: 1210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggaggttaccgatttccagtcctctagc

SEQ ID NO: 1211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggatctcatggttgcctatgaaagtgac

SEQ ID NO: 1212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggatgatcaggcatgagatcagttgctg

SEQ ID NO: 1213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggcaaggaagacggtgcgaaggtatcat

SEQ ID NO: 1214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggcacacatcacgcgtgcttgacgataa

SEQ ID NO: 1215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggcacctcaagcaccggatctctgcgcg

SEQ ID NO: 1216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggcaggccactcccattattgtatcaga

SEQ ID NO: 1217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggcagtattatccctctagccggcagtg

SEQ ID NO: 1218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggccttgattcggttgcagaaacattgc

SEQ ID NO: 1219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggctcgaccctatgtgtaaagcggaatg

SEQ ID NO: 1220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggctcgctcagctcttaggctattttcg

SEQ ID NO: 1221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggctcttgtgcctagctccttattggcc

SEQ ID NO: 1222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgggagcagagcgtagggcaccaatgggc

SEQ ID NO: 1223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgggagcctgcctgccctgcattaccgta

SEQ ID NO: 1224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggggaccgtcaaaacgcgcacagagcgg

SEQ ID NO: 1225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggggcgggctcagcgtacggaagcagtg

SEQ ID NO: 1226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggggtccgttggcggctgctcatgggta

SEQ ID NO: 1227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggtcaccctggaagagacgtccggtcga

SEQ ID NO: 1228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcggtcctgatctcatctcgcgattagcgc

SEQ ID NO: 1229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgtaagggagggatcatgcaagggaagtt

SEQ ID NO: 1230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgtagcagcagacagccgtactcacaccg

SEQ ID NO: 1231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgtccctccctacatctgtacatcatcat

SEQ ID NO: 1232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgtcgggctatgtctagtcagcaacggct

SEQ ID NO: 1233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgtctggccgacctttttgcttcgggcgc

SEQ ID NO: 1234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgtgggcatttagattgacctgcgttcgt

SEQ ID NO: 1235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcgtgtatagggtaggtatgcaactcttat

SEQ ID NO: 1236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctaatgagtcagtggtggtattgcatcgg

SEQ ID NO: 1237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctacgtacgccctgttcattcgggtggtt

SEQ ID NO: 1238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctacttcatgagagcagcatttttcccgc

SEQ ID NO: 1239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctactttgcggtgagtggttcgggagtac

SEQ ID NO: 1240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctagttaactaagtgtccttatcagaact

SEQ ID NO: 1241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctcacatcctgtagcgagaatctcatggc

SEQ ID NO: 1242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctcacccatttttggacagtatggatctg

SEQ ID NO: 1243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctcccattcaatgcttaagggggcctgtc

SEQ ID NO: 1244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctcggaagttgtgtagtttctctcaggcg

SEQ ID NO: 1245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctctacgtccccgggcggatctcagaagg

SEQ ID NO: 1246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctctcgcgattgttgcgtgctgcggagac

SEQ ID NO: 1247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctgaagcccgaaaacttgcttgtgtctgt

SEQ ID NO: 1248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctgattaaaagttaaacgggcgcgggctg

SEQ ID NO: 1249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctgcaacacaggactagtagggcggtgta

SEQ ID NO: 1250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctgggtgttgtcgagctcgtcgaacaggg

SEQ ID NO: 1251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcttaagggttgtcacggatatacgcgcgg

SEQ ID NO: 1252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcttactgcatatgttgtgggctaatcatg

SEQ ID NO: 1253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcttatactgttgttgttgattcggcacgt

SEQ ID NO: 1254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcttcgataacatataacagtatctacttg

SEQ ID NO: 1255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcttggggcggcagtaagggtggaatcaca

SEQ ID NO: 1256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagcttggttgatgtccctagagatcgtcccg

SEQ ID NO: 1257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctttactactcaattttgatttccgttgg

SEQ ID NO: 1258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagctttagacatcagactgccccaaagcctg

SEQ ID NO: 1259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaaactggtcattgtgtgtgtgatccttt

SEQ ID NO: 1260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaaatggtcccggagaaggctgcgatcaa

SEQ ID NO: 1261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaacacctttgaggggcgatcggcaggat

SEQ ID NO: 1262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaaccagacgttgtttaccataggacacc

SEQ ID NO: 1263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaacgcgtcgattttattactaagattac

SEQ ID NO: 1264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaagaagcgaatgtactactctagatgta

SEQ ID NO: 1265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaagaagggttttactcgtcgaaaatgat

SEQ ID NO: 1266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaagcagatgaagcgcgattcccgctacc

SEQ ID NO: 1267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaagcataaggatagtcagattacgctcg

SEQ ID NO: 1268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaaggggcctgtgtagacactagacgctt

SEQ ID NO: 1269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaagtcaacaaggtgcacaacccatgggc

SEQ ID NO: 1270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaagtggctctctagtctaacctgccatc

SEQ ID NO: 1271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaatcacgctgaggctgaataccaaatag

SEQ ID NO: 1272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaatctgcaacggggtcgtactcaaaggg

SEQ ID NO: 1273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaatttgaaggcgagagttagtgctggag

SEQ ID NO: 1274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggacagggcttggggttttcaaccgttgtg

SEQ ID NO: 1275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggacagtgccagggacttcgtccaccatca

SEQ ID NO: 1276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaccatcccgcgaaggtctgcgcatcacg

SEQ ID NO: 1277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaccgaatcggattttacacgcaaaccgc

SEQ ID NO: 1278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggacctgttgataccatacgccgtcccgcg

SEQ ID NO: 1279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggacggaaaggttcatgccatccctgttcg

SEQ ID NO: 1280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggacgttttcaaacaccatcacactatccg

SEQ ID NO: 1281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggacttacccactggctttgggcgcaacgc

SEQ ID NO: 1282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagaacgaacattcccacctgggtcgggc

SEQ ID NO: 1283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagacggattatttaaaacaagagcttcg

SEQ ID NO: 1284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagcaatggccgatatagaggggattctt

SEQ ID NO: 1285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagcgaggggtgagttggatacttcggtc

SEQ ID NO: 1286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagctatgggagcaatttttgtgtcgttt

SEQ ID NO: 1287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagcttatagtgtgacacctgaccggcat

SEQ ID NO: 1288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaggcagagcaggtcggcgggtttgcgga

SEQ ID NO: 1289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggaggggagttcgcgcagactcggttctac

SEQ ID NO: 1290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagggggaccaatgcttggtgggggcgga

SEQ ID NO: 1291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagttgaccctggaatggttgcgctagta

SEQ ID NO: 1292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggagttggccctgcatgttgtcttcgaggg

SEQ ID NO: 1293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggataggctgacggtcttttgaactgggct

SEQ ID NO: 1294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggatggcatagcacatgaggggagcggtct

SEQ ID NO: 1295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggatggccactttgtgactgggaacacgag

SEQ ID NO: 1296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggatggcccaactaccctcacacgtaccgt

SEQ ID NO: 1297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggatggtaaggttggctgatttctcactac

SEQ ID NO: 1298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggatgtcccagctcgagcacgccgcactag

SEQ ID NO: 1299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggatgtgggccagggagtggtcgaatgccc

SEQ ID NO: 1300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggattcgacgactcgagaaaccccagccga

SEQ ID NO: 1301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcaacgaggagacacgttactgggttggc

SEQ ID NO: 1302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcaacgagggtatacggcgcatactgatc

SEQ ID NO: 1303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcaacggatcgtgcggactgcccatcgca

SEQ ID NO: 1304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcaatgagtaggttatgcgagagttactt

SEQ ID NO: 1305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcaattccctaagttcgtcccgagaacgc

SEQ ID NO: 1306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcaccctcgcgacgaatattccactcggg

SEQ ID NO: 1307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcaccttcaaaacaaccttacgcgggctg

SEQ ID NO: 1308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcacggggccaaggattattttactgagg

SEQ ID NO: 1309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcacttctctacggcttttcctctaggcc

SEQ ID NO: 1310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcagcggttcatggattccacgattgcgg

SEQ ID NO: 1311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcagctactaacggcgcagactctctggg

SEQ ID NO: 1312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcagggggtcctaatttcccgagttgggt

SEQ ID NO: 1313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcagtaaggggacacagtggatatgacct

SEQ ID NO: 1314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcagtctgattgtagcgtgaggtttacga

SEQ ID NO: 1315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcagtgggcggtgatgggcttcgaatgtc

SEQ ID NO: 1316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcagttaaagacagttccaatccaaagag

SEQ ID NO: 1317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcatagtgtatgctgcggaacgtgttagc

SEQ ID NO: 1318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcatctcatagtcttgtgtactccccggg

SEQ ID NO: 1319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcatgatccagcgattgttaaaccaggga

SEQ ID NO: 1320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcatgtaaggttctcaataacgttggaga

SEQ ID NO: 1321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcattaggtccagtctcgcgccgttgcta

SEQ ID NO: 1322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccaatgtgcagtggcgtgagtgtaaagt

SEQ ID NO: 1323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccacccaatgtctgatgttccgggaggg

SEQ ID NO: 1324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccacggcgcgttcctacgattttgtccg

SEQ ID NO: 1325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccaggtgcagcgttccaccataaggaga

SEQ ID NO: 1326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcccaaacgatttatttaatacattcatc

SEQ ID NO: 1327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcccatgtgcttagtccagatccacgatt

SEQ ID NO: 1328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccgccggaatctcgtcctgaattccacc

SEQ ID NO: 1329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccggacgacattgggatttgttagggta

SEQ ID NO: 1330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccggctaagctgggcgatgacggcccgc

SEQ ID NO: 1331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggccgtctcccgtggatctgctgcagtaac

SEQ ID NO: 1332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgaaagtcccgctcaagtaatccgtccg

SEQ ID NO: 1333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgatggctgaggaaacgaccgtggtatt

SEQ ID NO: 1334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgcagaaggaacgtgtagggggcagttg

SEQ ID NO: 1335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgcaggacggcactgagtatggtgcgat

SEQ ID NO: 1336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgcatacgagggcctttgccacaaggtc

SEQ ID NO: 1337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgcctgagactaggacccgtcgcgctgt

SEQ ID NO: 1338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgcgcagggctttattgcgtgtggtgtg

SEQ ID NO: 1339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcggacccaggagtagtctctgctctcgc

SEQ ID NO: 1340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcggccatcagggaacgcttggtcgttgg

SEQ ID NO: 1341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgggacggtcactcgcaagtagcgcatg

SEQ ID NO: 1342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgggaggttgtatcgttgatccgggggt

SEQ ID NO: 1343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgggcacgtcatcttctctcttcataat

SEQ ID NO: 1344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgtaggaaggtgagttgcacatgtggcc

SEQ ID NO: 1345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgtccggagaacacttatcctttgttcg

SEQ ID NO: 1346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggcgtgtggtcaacctagggcatctagtac

SEQ ID NO: 1347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctcaggatgtgcttaccctgtcgttggc

SEQ ID NO: 1348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctcgcggaaagcccacgtctgtatggcc

SEQ ID NO: 1349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctcgctcggcgcattgctgactttgtgg

SEQ ID NO: 1350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctcgtgtggtttcgcgtcctccggtctc

SEQ ID NO: 1351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctgaatctccggacagataatacctgct

SEQ ID NO: 1352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctggaatattaacgatgggcaggaccgt

SEQ ID NO: 1353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctggttattctcacattactgcgtagaa

SEQ ID NO: 1354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctgtcaatgtggtatcgactccgagcaa

SEQ ID NO: 1355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctgtgttctttttaatgactacctccca

SEQ ID NO: 1356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctgttttcctctctcgggtcggttgtat

SEQ ID NO: 1357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggctttaatactagccaagaatcgagtgta

SEQ ID NO: 1358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggaactcatgcgtgctccgagtggaggta

SEQ ID NO: 1359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggaagaacaatgtttgagaaaaggttcga

SEQ ID NO: 1360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggaagctctatggacgcccgtgtttgcac

SEQ ID NO: 1361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggaagttcgaacggtgactctaccaggag

SEQ ID NO: 1362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggaatgcatcattcagatccatgtgcacc

SEQ ID NO: 1363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggacactggctactacttgcctccggacc

SEQ ID NO: 1364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggacctacctacgttcttcatcggcatgg

SEQ ID NO: 1365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggactacttagtttgtgccgactttttct

SEQ ID NO: 1366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggactataagggtgcgcgggtaggccgtt

SEQ ID NO: 1367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggactatgagagtcagatgatggcgatcg

SEQ ID NO: 1368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggactcgtagaacatgggggaagcaggta

SEQ ID NO: 1369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggacttttagtacattctaaagaatatgg

SEQ ID NO: 1370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggagaaagtagaaaaactgagcgcggtat

SEQ ID NO: 1371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggagacggtgcggaagcagcagcttttcg

SEQ ID NO: 1372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggagcgcgagataggttgttactataaaa

SEQ ID NO: 1373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggagcgggttctcagccagatgcgggcga

SEQ ID NO: 1374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggagcgtccgtctaggttggcctcggctc

SEQ ID NO: 1375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggagtcttcagctgagttcgaataacgcc

SEQ ID NO: 1376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggagtgttgtccgctcgtgtcgtacctag

SEQ ID NO: 1377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggatcgctcggcattcttgagtactttta

SEQ ID NO: 1378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggatggcactttcaggggtcgcttgacct

SEQ ID NO: 1379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggatgtgagctctggcaccttcacggtgg

SEQ ID NO: 1380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggcaaagtatttctatgatttttgtagct

SEQ ID NO: 1381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggcacgggatgtagcattcacaatgtcac

SEQ ID NO: 1382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggcagttggcaatacacacgttgaacagt

SEQ ID NO: 1383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggcctatgtgggggcctgataaactttgg

SEQ ID NO: 1384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggcgaggtccgctggtaaacggcgctggg

SEQ ID NO: 1385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggcggcgcttcgagcacacgcttgtacgg

SEQ ID NO: 1386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggcggtactccatgcaatcattggaggtg

SEQ ID NO: 1387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggctaatctcgactctttcctcgctaacg

SEQ ID NO: 1388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggagcttttctcccacgctgcttacttt

SEQ ID NO: 1389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggaggctcaattcagagacgtcggtgaa

SEQ ID NO: 1390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggcagttatgttaagtggatgaaaagct

SEQ ID NO: 1391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggcatgtaagagtacggttgagctccga

SEQ ID NO: 1392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggcggacgtgttgggctacccacttggt

SEQ ID NO: 1393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggggtgaaggagagcgcctactgtcgagg

SEQ ID NO: 1394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggtattcagtcaggcgccaatcctgcgt

SEQ ID NO: 1395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggtccaaccattatcaaaacggcgcgca

SEQ ID NO: 1396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggtctcacttgtctgtctgggcgttccg

SEQ ID NO: 1397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggtgctacgatcggaagtttgtgggcga

SEQ ID NO: 1398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggggttgctatgcttggcctggcgcactcg

SEQ ID NO: 1399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggtacgtctcggtattcgcgccacggtgc

SEQ ID NO: 1400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggtccgattgacctgtgaaactgcgcgct

SEQ ID NO: 1401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggtgagcgacttggtcgagatgtggcccc

SEQ ID NO: 1402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggtgatttgcatcgagcacgacatagctc

SEQ ID NO: 1403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggtggcgttccgggtgcaggttttgaagt

SEQ ID NO: 1404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggttcaggttcggttggcggcaaaactgc

SEQ ID NO: 1405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagggttccatcaagctcggcctccggttact

SEQ ID NO: 1406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtaaaggggtagatggggatgatttgacg

SEQ ID NO: 1407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtaacaacccgtccgtacttgagagtgca

SEQ ID NO: 1408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtaaccgcgtcccggcagtcttcgtacgt

SEQ ID NO: 1409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtaaggtcgtgtcaggttgctctagtacg

SEQ ID NO: 1410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtacaccttacggttccaatactgtggag

SEQ ID NO: 1411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtaccgcggcaactcccatcgtgctcccg

SEQ ID NO: 1412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtacgcgcacgacgatttcagggactccg

SEQ ID NO: 1413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtacgttgggtggggatttgcactcgact

SEQ ID NO: 1414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtatacagcttgcggtaagttcgtggttt

SEQ ID NO: 1415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtatagagctcgtttacaataatgcctca

SEQ ID NO: 1416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtatagcacacctgctgaaatcaatccga

SEQ ID NO: 1417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtcacttgaaatagtttgtttgtccgctt

SEQ ID NO: 1418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtcagaaaaggcgtcttacccaaggtggg

SEQ ID NO: 1419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtccgatactccatcgtcagatcatacgc

SEQ ID NO: 1420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtcgagtactgccgggaccacatctttac

SEQ ID NO: 1421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtcgctgataattatcaaggtttcaggcg

SEQ ID NO: 1422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtcttatagagacatacgccattgtacct

SEQ ID NO: 1423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgaaaataatgcaagacggttaatggtt

SEQ ID NO: 1424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgaattaatactgtgggccaacctcggt

SEQ ID NO: 1425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgacgggttatgtgttagttttctgcgc

SEQ ID NO: 1426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgagggaagcgctattgctggtattcgg

SEQ ID NO: 1427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgcccattaggccgggtgtgaatcgcct

SEQ ID NO: 1428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgctacactattatgggtggagacgcca

SEQ ID NO: 1429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtggctcttggcctgcctgttttgtgtta

SEQ ID NO: 1430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgggcgaagagctgctcaatgctgacaa

SEQ ID NO: 1431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtggttctcactcggtggaaattggacgc

SEQ ID NO: 1432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgtatagtggcttaaacccctctgcaac

SEQ ID NO: 1433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgtgccagttgcagatcgtattcccgtt

SEQ ID NO: 1434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgtgggctcgctgacgcgtatgttggtc

SEQ ID NO: 1435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgtggtacatctgatcgcttctgggtcg

SEQ ID NO: 1436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtgttcgtcactcgctttaactctgggtg

SEQ ID NO: 1437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttacagtgccagggaggtagcactctgt

SEQ ID NO: 1438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttataccgggcgatttaactttatgacc

SEQ ID NO: 1439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttcagtagcggaacaagttagatccgcc

SEQ ID NO: 1440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttcggatgacgattaacgttttttgtgc

SEQ ID NO: 1441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttgacggaaccgcagcgtatacgggaag

SEQ ID NO: 1442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttggcttacactgatcggtggcagtctc

SEQ ID NO: 1443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttgtgtgacatgccatcacaagtccccg

SEQ ID NO: 1444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtttccagatggacatgtgaattgcgtct

SEQ ID NO: 1445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtttgatccgtcacatttacgtttgagga

SEQ ID NO: 1446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttttacagatgcagatggaagaacttgt

SEQ ID NO: 1447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggttttcgtcttgggactcttgggtcgtgt

SEQ ID NO: 1448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aaggtttttaggccacatactcgtttgatcgc

SEQ ID NO: 1449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtaaccacaggtctgtaggcaggcactcgg

SEQ ID NO: 1450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtaatagctcggcaactcctgtgcccgaca

SEQ ID NO: 1451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtaatattactcgttctataatgatgtata

SEQ ID NO: 1452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtaattctgggtttgatacgggtttgctcg

SEQ ID NO: 1453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtacactagcatctgccgggtcctaataga

SEQ ID NO: 1454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtacactgtttggaaaatctactaaccgtc

SEQ ID NO: 1455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtacaggaccggcattctcgatcgttgagg

SEQ ID NO: 1456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtaccattgtgtggccaagttacttatacg

SEQ ID NO: 1457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtacggtacatgcgtgttgctgtcttaggg

SEQ ID NO: 1458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtacgtactgcatcttggttaaataattga

SEQ ID NO: 1459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtacgtgcttatagccttgacgtaattttc

SEQ ID NO: 1460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtactcgcgggtccagcgcgaacagtgagg

SEQ ID NO: 1461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtactctacaataaacatgcgggttaaatc

SEQ ID NO: 1462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtactgtctagctctaaactgaacctgctc

SEQ ID NO: 1463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtacttactaatgaagaacagtttcattgc

SEQ ID NO: 1464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtaggacgcttctaaggcacgggcattcat

SEQ ID NO: 1465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtagtatcttagtcctagctgttagttcta

SEQ ID NO: 1466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtagtggacgccacgaagacggccagtgca

SEQ ID NO: 1467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtatatcctttacgtggggataagggaatc

SEQ ID NO: 1468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtatatttaacagcaggatggagtttgccg

SEQ ID NO: 1469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtatcacgccctttcgacctgtggacgtcc

SEQ ID NO: 1470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtatcaggttaggaaatcagtgccgatcat

SEQ ID NO: 1471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtatggcagcttaacggagccaggtcgccg

SEQ ID NO: 1472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtatgttagcggagtcaggtggtgttatcg

SEQ ID NO: 1473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtattaattttagcggaacgtatcttttct

SEQ ID NO: 1474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtattaggcacagctgcaggtctcatacgt

SEQ ID NO: 1475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtattattgatataacaacgctgatccgta

SEQ ID NO: 1476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtattgtttttcggctgtggggccttaacg

SEQ ID NO: 1477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcaaagcggaggtgctgtattgagccgta

SEQ ID NO: 1478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcaacggcaacatttacacccatctgcgc

SEQ ID NO: 1479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcaacggtttgggaggtggacagcgatca

SEQ ID NO: 1480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcacccgcaagactggttgagaagtagca

SEQ ID NO: 1481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcagtcgccaagtgttttgcgatcaatcc

SEQ ID NO: 1482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcatcccactgtgctaagatcgggccgcc

SEQ ID NO: 1483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcatgagcgtttgcaaaaagcgctttccg

SEQ ID NO: 1484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccaaagttccctcgggcttcgcgtgcgc

SEQ ID NO: 1485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccactcactgaggggatgcgaactgaat

SEQ ID NO: 1486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccatttcttctagataagacccacgaca

SEQ ID NO: 1487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccgatgcttagtcctttcggtgtctcgg

SEQ ID NO: 1488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccgcggcatatgtgccaaggggaggacg

SEQ ID NO: 1489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccgctggaggacccgatcaatgacgctt

SEQ ID NO: 1490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccgtcgttaggggagagatgtaggtaca

SEQ ID NO: 1491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcctgggggcattgaatggtgtgtcctat

SEQ ID NO: 1492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcctgttggctcctgggtttttatcttct

SEQ ID NO: 1493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccttcctcacgggcacaatcgtatttgc

SEQ ID NO: 1494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtccttttgacttgaacaacctcaccccgt

SEQ ID NO: 1495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgaagtgtcaccggccccgtcaatgtgc

SEQ ID NO: 1496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgaatcatgggtggtactggaggcattg

SEQ ID NO: 1497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgaatccggtgagtcgcggcacatgtcg

SEQ ID NO: 1498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgacggttaagttctaccagtacctttc

SEQ ID NO: 1499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgcaggtcatctagttgagtcatatttt

SEQ ID NO: 1500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgcgctccgccaattcgtgatggttatc

SEQ ID NO: 1501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgctaacgatgagagtttgacaggggaa

SEQ ID NO: 1502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgctatctggccacgcaggccaacagag

SEQ ID NO: 1503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgggggatttcgttctccatgcccttgt

SEQ ID NO: 1504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcggttgcacactgttctatgcctagacg

SEQ ID NO: 1505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgtaggctgccccaggggcgggtaatcg

SEQ ID NO: 1506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcgtgcccgtgcagtatggtgtcccggag

SEQ ID NO: 1507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtctagtacgccaacagcctagccctgtcc

SEQ ID NO: 1508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtctcttttcatggggggcttttgttcgcc

SEQ ID NO: 1509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtctgtatcattcaatggcggtgtcgccgg

SEQ ID NO: 1510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcttagcgaggatcgtttcacatcgcggg

SEQ ID NO: 1511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtcttgctccctggccgacgcttccacccc

SEQ ID NO: 1512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgaacgagcaacaatcttggtcgggggtt

SEQ ID NO: 1513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgaagaggaatgactgcgtcggctgtgtg

SEQ ID NO: 1514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgacacgtaggcacctgcgcgtttgtggg

SEQ ID NO: 1515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgaccgtgggattgtggtattgcttgggc

SEQ ID NO: 1516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgacgaagtcaagccggcaaggcatctta

SEQ ID NO: 1517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgactggcagagggcataaaacggaggcc

SEQ ID NO: 1518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgacttgctatggaattccgtttgatcga

SEQ ID NO: 1519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgaggctatgttgattgtgtcggtggagc

SEQ ID NO: 1520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgagtgaatgaaaaacttgcactaaatca

SEQ ID NO: 1521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgatcatactacgctctcctcagagttgc

SEQ ID NO: 1522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgcacgcagaacggtttaattcgattagt

SEQ ID NO: 1523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgcagcacggttaagatgcttaagtacca

SEQ ID NO: 1524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgccaaggtcgtctaagcgttgccctaag

SEQ ID NO: 1525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgccatctcgcagacctgcccacaatgga

SEQ ID NO: 1526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgcccgtccactagttggaagaggtaggt

SEQ ID NO: 1527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggacgcataagggtcgttggcaagtttt

SEQ ID NO: 1528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggatgggaaatattttgaatcgcaatga

SEQ ID NO: 1529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggccggtcacgccattgcgagtgcgcat

SEQ ID NO: 1530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggctcccgactagcggaatgtgcgtaag

SEQ ID NO: 1531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggctctggtgtgggtaagttggctcagc

SEQ ID NO: 1532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggctgcctataatctccgtgcggttaat

SEQ ID NO: 1533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgggatcggatcgccttgacggaggatcg

SEQ ID NO: 1534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgggctgctcaaaccttgataccgatgtg

SEQ ID NO: 1535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggggggtgacgggccgccctttggtatc

SEQ ID NO: 1536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgggtaccagacgactaagtttgcatcgt

SEQ ID NO: 1537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgggtttcacatcattatagactggcgca

SEQ ID NO: 1538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggtaccgagcggcagcagggaaggcggc

SEQ ID NO: 1539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggtactgcggtggatccgtgattctgcg

SEQ ID NO: 1540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtggttcgggtcggccctgcattaggttag

SEQ ID NO: 1541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtaccgaccggttaacatggatttcttc

SEQ ID NO: 1542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtaccgctcacacctatctcgttttgcg

SEQ ID NO: 1543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtaggttagtaggctagtaaagtgcgtc

SEQ ID NO: 1544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtagtcatatctgttcgggggatcctgc

SEQ ID NO: 1545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtatcggtctacaaaacgccggcctacg

SEQ ID NO: 1546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtatgttaataaatgttggccagatgtt

SEQ ID NO: 1547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtcaaagatcgagtaatttcacagtctg

SEQ ID NO: 1548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtcgtgttgcgtcaattcttactttcca

SEQ ID NO: 1549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtgaacgtggtttgctatgcattgtagg

SEQ ID NO: 1550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtgcatgagcctcccctgggctagagat

SEQ ID NO: 1551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtgcgggtagtgcaaattaaatgactag

SEQ ID NO: 1552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtggccaacgtcgggtcgggtgccaggg

SEQ ID NO: 1553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgtgtgcttggggttgaagctgtacgtac

SEQ ID NO: 1554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgttgactggtgggggcctatatccgtct

SEQ ID NO: 1555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtgttgtcttgaggaagaatatactgctct

SEQ ID NO: 1556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttaagcatttccgtgactccgcggttgta

SEQ ID NO: 1557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttaccgaaatccgggtcacctagacgctc

SEQ ID NO: 1558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttaggtttcggtggggcatgcatcttgga

SEQ ID NO: 1559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttatgacccaaattgcttgtatactcgcg

SEQ ID NO: 1560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttcaagtaggaactagtggtaacttacat

SEQ ID NO: 1561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttcaatcctcggactaagctccgataagc

SEQ ID NO: 1562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttccgcggatcctcgctctcacaccagta

SEQ ID NO: 1563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttccgttttgaccagtgaccgttatgaac

SEQ ID NO: 1564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttcctcccgatcttgacgtgacgacgatc

SEQ ID NO: 1565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttcggaataggttgttgacgagttcaccg

SEQ ID NO: 1566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttctcaggcctcttggagagggcttaggt

SEQ ID NO: 1567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttctgaagcgctaaccttgtttcgtagta

SEQ ID NO: 1568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttctgcttatgaggatcgttgttatagtt

SEQ ID NO: 1569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttgacattagggagtggaggacctggggc

SEQ ID NO: 1570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttgtagatggacggacagcaggagtggtc

SEQ ID NO: 1571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttgtgcaaggtgcgggtgtaatgtacgtt

SEQ ID NO: 1572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtttaacatagtataaagagacgggtctga

SEQ ID NO: 1573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtttataattctaggcgagcgcgtcttcca

SEQ ID NO: 1574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtttcgagtcttccgttttcgcgtataccg

SEQ ID NO: 1575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagtttggtacgtcgagccagcctatgtctta

SEQ ID NO: 1576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aagttttgataaaacagtgtggagtacggtac

SEQ ID NO: 1577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataaaccctcgctaatacaacgtctggttga

SEQ ID NO: 1578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataaagctctttattaagcttaacaaacacg

SEQ ID NO: 1579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataaaggactgagttagcagactcgaaggta

SEQ ID NO: 1580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataacaacttttagtcgtactgaaatggagg

SEQ ID NO: 1581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataacactctgagaggttctgggggcggcgc

SEQ ID NO: 1582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataaccgcaagttcaaggtccagttgtagac

SEQ ID NO: 1583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataacggtaactcgctgggtttcggtaggct

SEQ ID NO: 1584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagagtgtacacattcttaactgaccgcg

SEQ ID NO: 1585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagcaaggcctggaccgctgaccggaact

SEQ ID NO: 1586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagcgtgtttgggtgtctgtctgtctacc

SEQ ID NO: 1587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagctcacggcaagaatacgtggtcagcg

SEQ ID NO: 1588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagctcatacccgctctctcgatgggtcg

SEQ ID NO: 1589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagtattgcaggtacgctccactttttcc

SEQ ID NO: 1590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagttattgtaacctcaaatgggacactc

SEQ ID NO: 1591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataagttgctagtacggtgtcgtgcgtggtc

SEQ ID NO: 1592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataatccatgttaactgcgtagccgtggccc

SEQ ID NO: 1593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataatcggagaagcggagcgcgtcgttcttc

SEQ ID NO: 1594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataatgggagctgcagcgggtggaactaatg

SEQ ID NO: 1595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataatttctgaccgccatattcgagcaatag

SEQ ID NO: 1596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacacggcgctcgagcttattctggagaag

SEQ ID NO: 1597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacaggtccacgtatttcgccatccattcg

SEQ ID NO: 1598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacatagggatcatttctacacagcgtctt

SEQ ID NO: 1599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacatggtattagttctttaggcatgttgg

SEQ ID NO: 1600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacattccaggtctctaaacgcgagcacga

SEQ ID NO: 1601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataccgacattaaggctcactttagttcctc

SEQ ID NO: 1602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataccgatatgcccgattcataagacttgta

SEQ ID NO: 1603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataccggcattctcatcagacctactatgtc

SEQ ID NO: 1604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataccggcctcctgtacaccccatgacgatg

SEQ ID NO: 1605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataccgtagactccgggtgcctcatatcttg

SEQ ID NO: 1606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataccttaaaccgcccgtagcagctattgtt

SEQ ID NO: 1607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataccttcgggcgccttgaaatgagcaaccc

SEQ ID NO: 1608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacgaaacggttttgtgaaataaagcccta

SEQ ID NO: 1609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacgaccgtattatagtatcaagtcgtgcg

SEQ ID NO: 1610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacgcctaatgtaggagtaatagtcccgtc

SEQ ID NO: 1611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacgctcttctttgggttaatggttacgaa

SEQ ID NO: 1612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacgcttgaggtagtggcagtttttatgtc

SEQ ID NO: 1613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatacgtgtcgcgatctcacaattggtatttt

SEQ ID NO: 1614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatactaataccattaggcagttttatgggcg

SEQ ID NO: 1615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatactcgtcttattagtaacgaagtaattct

SEQ ID NO: 1616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatactttgtcaagctctcgctgcctgcacat

SEQ ID NO: 1617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagaaatgattacggtgatctggggctttg

SEQ ID NO: 1618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagaccaccttctcaggagatgtccagaat

SEQ ID NO: 1619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagagggtcttttgcgccctgtgcggctgc

SEQ ID NO: 1620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagatcggatcctagtgcatttccctgtcg

SEQ ID NO: 1621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagcaaagttgtgggagacgaacgacctcc

SEQ ID NO: 1622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagcagtagtatcgatggaggcgtccctta

SEQ ID NO: 1623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagcgcacacagagcgttagggatctaatg

SEQ ID NO: 1624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagctagttagtcgcgtcacttacgactag

SEQ ID NO: 1625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataggacttcttgtggggtgataagccgtaa

SEQ ID NO: 1626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataggcccgactaggattggaatactcggcg

SEQ ID NO: 1627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataggctgtagcataggcagcgatcaacttc

SEQ ID NO: 1628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataggctgttctggtatatattgaatggtca

SEQ ID NO: 1629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagggccgacggtcgggacagaaaagcgcc

SEQ ID NO: 1630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataggtcaaaaatgtgatcttttgacattcc

SEQ ID NO: 1631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataggtctcacgccatcacccacgccagtaa

SEQ ID NO: 1632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aataggttgcgatacgcgggaatccaaggtcg

SEQ ID NO: 1633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagtatgggttgagtatccgtccaacgatg

SEQ ID NO: 1634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagtattttcgagaaatgccgaggcaaatg

SEQ ID NO: 1635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagtcagacaacacgctggatttgtctcga

SEQ ID NO: 1636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagtcggttcatacggccattatgcccctc

SEQ ID NO: 1637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagtctctcctccggtgcggttttactgcg

SEQ ID NO: 1638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagttcccgcttcgagctccgtcttaactt

SEQ ID NO: 1639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagtttacctctcgttcctgttatgtattc

SEQ ID NO: 1640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatagtttttgacctgcccggtcttcaatcgt

SEQ ID NO: 1641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatacaggaatttccgttttgcacaagtcc

SEQ ID NO: 1642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatagacccagacatatctgtaccgggcac

SEQ ID NO: 1643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatatgaaaaagcaccgtcgactgtcaacc

SEQ ID NO: 1644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatattacggctcaacctaggagtgggagg

SEQ ID NO: 1645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatattcgaggcaaattgggaccgataatg

SEQ ID NO: 1646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatattggatgcgtagtgcttacgcccacc

SEQ ID NO: 1647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatcaagctggtgctggtcctctttatacc

SEQ ID NO: 1648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatcagagactagcagtcgtgttttagaga

SEQ ID NO: 1649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatccgtgtcctactgcgggggctcacgtt

SEQ ID NO: 1650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatcggctactgacccgagctgatcagcga

SEQ ID NO: 1651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatcgtagcgctaacgacgacctttcgaag

SEQ ID NO: 1652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatcgttacatgtggccgcgctcatgttcg

SEQ ID NO: 1653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatctgattcgttaggccagtattcgtttg

SEQ ID NO: 1654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatgaatagcccctttgcgctcttaattaa

SEQ ID NO: 1655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatgccccccagtgccaacccgatgtccgt

SEQ ID NO: 1656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatgctgctaagtgcggacacaactcttga

SEQ ID NO: 1657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatggaataatgctgtaacggccgagatcc

SEQ ID NO: 1658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatgtgcacaagcgtttcaccgccgggcgc

SEQ ID NO: 1659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatatgtttcggacttgaccagcggtggtggc

SEQ ID NO: 1660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatattagggtgcctaaatagggcgctaagcg

SEQ ID NO: 1661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatattattcggatccggtactagcggcacgg

SEQ ID NO: 1662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatattcacagtctgccgctcgttacttttcc

SEQ ID NO: 1663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatattgagttgggtgcttttaatgattctct

SEQ ID NO: 1664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatattgcaaggaacacgttaaggctgggttg

SEQ ID NO: 1665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatattgcctgactcatggagattcctgatac

SEQ ID NO: 1666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatattggagttgatgtcggttgggctagtag

SEQ ID NO: 1667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaaacgagggtgtcacaaggtctgctccg

SEQ ID NO: 1668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaacccgcctggcccatattgttgctgca

SEQ ID NO: 1669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaactactatgtcttattgggacctgttc

SEQ ID NO: 1670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaactcaccgcttatcagtttgggcacgt

SEQ ID NO: 1671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaagtcacttctgttcgtttttggatggg

SEQ ID NO: 1672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaattgtttttgaccggttgctcgggttc

SEQ ID NO: 1673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaccagagcctgagcaaccacacagctcg

SEQ ID NO: 1674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaccgatgggcggggaatcacgtgttggt

SEQ ID NO: 1675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaccggacgcacgccacgtcattcacatg

SEQ ID NO: 1676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcacgagttcccctgagattctctccgagt

SEQ ID NO: 1677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcacgcagagggacctctaggcactctctc

SEQ ID NO: 1678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcacggctcatgtgctaccgcgcaatggtg

SEQ ID NO: 1679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcacgtacccgcaatagatcaacgggtaga

SEQ ID NO: 1680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcactagcagcttgatactagttcgaattc

SEQ ID NO: 1681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcagaacgacgccccttcgtgctttcggct

SEQ ID NO: 1682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcagcgtacaggcggacagtcgcgcacggc

SEQ ID NO: 1683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaggcaagtgaatctcttgacatgtgacc

SEQ ID NO: 1684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcaggtaagtcccgcaacggatcgctgtgc

SEQ ID NO: 1685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcagtatgcctcgcaccgtacagagtgttc

SEQ ID NO: 1686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcagtctgttttcgtccacgcacttatact

SEQ ID NO: 1687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatcaatacaacctatttacggaggggca

SEQ ID NO: 1688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatccgctcgctgaatgcacgctattgag

SEQ ID NO: 1689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatccgtaggttgttgcgcgcctcgcctg

SEQ ID NO: 1690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatgacagatcaaacatgaccggaaggcg

SEQ ID NO: 1691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatggccccttcatgttcactctgccggt

SEQ ID NO: 1692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatgggggaaccgatttttttactcttct

SEQ ID NO: 1693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatggtcagctccagaagaagagaactcc

SEQ ID NO: 1694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatgtagcaatggcaataggaacgcacga

SEQ ID NO: 1695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatgtatacataccggtccattgggtggt

SEQ ID NO: 1696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcatgttttgtagaattcgtatctccaggg

SEQ ID NO: 1697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcattgcttgtactgaccgtgcaattgagg

SEQ ID NO: 1698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccaaaggtcgaacccggctactctcatgt

SEQ ID NO: 1699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccaacttgcgtatagcgcgtttcctcgga

SEQ ID NO: 1700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccactgtggcatcgcgtcacgacggttgg

SEQ ID NO: 1701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccagcgtttagcctctgaaatggaccagg

SEQ ID NO: 1702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccagcgtttcgtgtgcggagatgggctcg

SEQ ID NO: 1703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccaggctaaatcgtcccttgcggatactc

SEQ ID NO: 1704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccatgggacaatcctcagacagcgcacgt

SEQ ID NO: 1705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcccaaattacccacggcacgactcgactc

SEQ ID NO: 1706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcccagtggttcctcaatatacttcttgcc

SEQ ID NO: 1707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccccgcactcccgtcttcattccggccga

SEQ ID NO: 1708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcccgccgatggttacaacccaggctcgtt

SEQ ID NO: 1709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccctccggagctggcgcactgtataagcg

SEQ ID NO: 1710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccctggggtctcttgctctgtgttagcat

SEQ ID NO: 1711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgattcgcactagagagtgggccgctct

SEQ ID NO: 1712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgcaaatgattcccctttcccctagccc

SEQ ID NO: 1713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgcaggtccccttccttatgaccacccg

SEQ ID NO: 1714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgccatcaaccgacaatgggtgcgtctc

SEQ ID NO: 1715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgcccttgcgtgtccctgatcacggttt

SEQ ID NO: 1716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgcgtcctaatggattcgactcgcataa

SEQ ID NO: 1717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgctgtctagtacgtatcattaacgatc

SEQ ID NO: 1718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgtatgccattcgacagtgaggtggcac

SEQ ID NO: 1719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatccgtggttcgagcgccgaatcacacactc

SEQ ID NO: 1720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcctaagcttacagcatgatcctacgagcc

SEQ ID NO: 1721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcctctttattcggtgggcttctctgcttg

SEQ ID NO: 1722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcctgcagcaataagcggtcgatgcaatcg

SEQ ID NO: 1723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcctgtccttcacttgtgtggcgaaaaccc

SEQ ID NO: 1724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgaatgtcgaatggactaggttcttactt

SEQ ID NO: 1725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgacatggttttgacctttgcatttactc

SEQ ID NO: 1726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgagcacggttgtgaagtatggacactcg

SEQ ID NO: 1727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgagcgactttttttgttaaatatgctta

SEQ ID NO: 1728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgagcttatgtgtctattggccatggccg

SEQ ID NO: 1729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgagtttgtatgcggtgaatcggtatggg

SEQ ID NO: 1730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgcaattctgtttgcgaactttgatcaac

SEQ ID NO: 1731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgcatgttcttgggcgtgacgcggttttc

SEQ ID NO: 1732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgccgactttatgcgtgtgtagcgttcgc

SEQ ID NO: 1733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgccgcgctacgtaatgcgtctccagcac

SEQ ID NO: 1734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgcctgaagcggggacttctctgacggtt

SEQ ID NO: 1735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgctactctcaaggacatttgagtgagca

SEQ ID NO: 1736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgctatctatgaaaagctaccctgggccg

SEQ ID NO: 1737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggatcgggcatgtattagaccggtttgt

SEQ ID NO: 1738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggccgctggatcaaatcttttatttatc

SEQ ID NO: 1739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggcgcagctttgtacgatcatgttcatg

SEQ ID NO: 1740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggcggcagtcgtgttgagcggaccgtaa

SEQ ID NO: 1741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggctctgctttcccatatagggttttgg

SEQ ID NO: 1742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgggatccaacttgccaccaggctgagat

SEQ ID NO: 1743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggggaattttcgttcgtttctgtgctaa

SEQ ID NO: 1744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggggattgtattcttgtgcctctgccca

SEQ ID NO: 1745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggggtttggactgagtttggcttctagt

SEQ ID NO: 1746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgggttatcaatttacctaagcgtacttc

SEQ ID NO: 1747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggtcggttcccacctattttcagccaag

SEQ ID NO: 1748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggtgctggattacatgggtgctgccact

SEQ ID NO: 1749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcggttatgatgctcaatgaacctacacgg

SEQ ID NO: 1750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgtaatgaccaagtgcccgaattggtgtg

SEQ ID NO: 1751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcgtctatagaatacgctaaagtcgcttcg

SEQ ID NO: 1752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctactcgtcttcgatcacccttctgtctc

SEQ ID NO: 1753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctaggtctggcacacccgataaccatgag

SEQ ID NO: 1754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctcaggagtctggacacgacctgcacacg

SEQ ID NO: 1755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctccaggctccggttatcccatgcggtgg

SEQ ID NO: 1756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctcgaggaagagatagcttgccagccatt

SEQ ID NO: 1757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctcgcattcgttcagtgcaatggtcctgt

SEQ ID NO: 1758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctcgtgtccccatgcagggtgttgcggca

SEQ ID NO: 1759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctctcttacgagttttcctcgatgtgtta

SEQ ID NO: 1760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctgccatagtaacaccatggactagagtc

SEQ ID NO: 1761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctgcgccagttggaggttaagctagacgt

SEQ ID NO: 1762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctgggccgtattcttgcaaatggagggtc

SEQ ID NO: 1763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctgggtgtcttcctcatattcttgtggtt

SEQ ID NO: 1764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctgtcgggcgaagtcgagggatgcatagg

SEQ ID NO: 1765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatctgtgcaaattacttccttatacgaccgc

SEQ ID NO: 1766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttagatgattgttttgccgttcggggtg

SEQ ID NO: 1767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttccgacgtcactcgggtcaatctaggg

SEQ ID NO: 1768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttcgaaaaaccgatcgtttggacggcga

SEQ ID NO: 1769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttcgatgttttcctgctgaggcttttcg

SEQ ID NO: 1770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttgatacggttgttgagccgcatgaagc

SEQ ID NO: 1771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttggtgtgcccgcgtgtgttcggttcta

SEQ ID NO: 1772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttgttatcaccttaggagtcgttaggac

SEQ ID NO: 1773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatcttttacttggagtaaatggggaacagga

SEQ ID NO: 1774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaaatatcggttagtacccgtggacaagg

SEQ ID NO: 1775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaaatcgctccctcgccgcgctccgttaa

SEQ ID NO: 1776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaagatcacctgtaatacgctactccttt

SEQ ID NO: 1777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaagccactgttgcgggtccttcttgccg

SEQ ID NO: 1778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaatccgcgaattcctgctaacggggagc

SEQ ID NO: 1779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaatgtacagtcttaattctttgatcttc

SEQ ID NO: 1780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaattgatgtgtcatgatttactttcggc

SEQ ID NO: 1781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgacaagtgcctccacgacgacaaccagct

SEQ ID NO: 1782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgacaccgcggcacagaactattggcttag

SEQ ID NO: 1783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgacgcatgtttaataatttaatgcacaag

SEQ ID NO: 1784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgacgtgtggtctcattaggtttcggcata

SEQ ID NO: 1785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgactatatcttttaccagtgactagagca

SEQ ID NO: 1786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgactatggggcgtgaattgtttggtcgac

SEQ ID NO: 1787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgactggtctgctacagccccagacacagg

SEQ ID NO: 1788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgacttggtaggaatccttcccttgtgcat

SEQ ID NO: 1789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgagaatccttcaagagataccgccccctt

SEQ ID NO: 1790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgagaggctcgagatgtttccttgaagcgt

SEQ ID NO: 1791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgagccaactccagtctgcgcctaacatac

SEQ ID NO: 1792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgagctatctctttgggtccttcggtactc

SEQ ID NO: 1793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgagcttttgatcagtgtatgagcagtata

SEQ ID NO: 1794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgaggaattctcgggtggaccgcgggaccg

SEQ ID NO: 1795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgagtagcatatccgccgttcaaggtaggg

SEQ ID NO: 1796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgagtgcttagtaagtttaagggcgggccg

SEQ ID NO: 1797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgatagcgatgggatcagtcctccccttta

SEQ ID NO: 1798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgataggcaagttcggccgtgtgtatttgc

SEQ ID NO: 1799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgatcaatttgtaaaaccatcatgcattgt

SEQ ID NO: 1800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgatcgggccggctctgatacgcggtttgt

SEQ ID NO: 1801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgatgaatggtcttcagacgttttcccgta

SEQ ID NO: 1802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgatgcaagggatgaggggtacgcagtcaa

SEQ ID NO: 1803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgatggtcttggctttattagctttgccga

SEQ ID NO: 1804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgatgtttggacggatcaatcgacgagcgc

SEQ ID NO: 1805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgattcagagttgctgaagtatttgcacga

SEQ ID NO: 1806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgattgcgttcacgcagctcgcgtcagtca

SEQ ID NO: 1807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcaaatggatgcgttgtgggtaatcgtta

SEQ ID NO: 1808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcaacggcaaccgtcgttcccagtgctgt

SEQ ID NO: 1809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcaatggaacagcttttcgtgggatgcgc

SEQ ID NO: 1810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcacagtctgtcgatacaacctagggggt

SEQ ID NO: 1811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcacggtcgtccctcttaagataggcata

SEQ ID NO: 1812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcacggtgtcactttgctcaatatccgcc

SEQ ID NO: 1813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcaggctggtgttgatgggcggattgtaa

SEQ ID NO: 1814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcagtactttgcgtctcatgtttgcgaga

SEQ ID NO: 1815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcagtgaacctttggagggtataaccact

SEQ ID NO: 1816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcatggatggcaacggggcctgattgcca

SEQ ID NO: 1817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgccaggcgtaaacaggaggctgttgcacc

SEQ ID NO: 1818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgccatccttagaaacagactgtcgtaccc

SEQ ID NO: 1819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcccgaaagtactctgatgttcctcggta

SEQ ID NO: 1820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcccgagttgattgcgtgacctttgagcc

SEQ ID NO: 1821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcccgtagacagggtggtgttctgcggtg

SEQ ID NO: 1822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgccgactcgaatggaggtttgtcgcttta

SEQ ID NO: 1823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgccgatcctttggtgacggagcggtggaa

SEQ ID NO: 1824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgccgtcgactccgtctctgtgccgttcgg

SEQ ID NO: 1825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcctatatttgtatcggagggatctagtt

SEQ ID NO: 1826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgccttaaccaggctggttacggaggggta

SEQ ID NO: 1827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgaacattgttcaagcaaacggatgagc

SEQ ID NO: 1828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgaatatggttgtgtctctataaacatc

SEQ ID NO: 1829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgaccttatgtgactcggtaaaccgtac

SEQ ID NO: 1830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgaggttagcagctcggttgtagcgcta

SEQ ID NO: 1831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgattagcctggcagctgcgcctcctcc

SEQ ID NO: 1832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgcaacggttggctcttcatctggcggt

SEQ ID NO: 1833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcggtcagaagggtgaatcgtggtctttg

SEQ ID NO: 1834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcggtgacagctagtgtacacaggcccgc

SEQ ID NO: 1835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcggttcacttgatgcttgattattatga

SEQ ID NO: 1836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgtcaaaacaggaggaactggggtagcg

SEQ ID NO: 1837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgtcacttatctctgcctcttgaactac

SEQ ID NO: 1838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgtctgaatttttaccattgcccggtaa

SEQ ID NO: 1839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgtgtcgtcgatattatgttgggatgtg

SEQ ID NO: 1840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcgtgtttaatttctggggaaacagaagg

SEQ ID NO: 1841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgctatgctggtattctgtggaactcgacc

SEQ ID NO: 1842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgctgggttatatgcatgctctggtttctt

SEQ ID NO: 1843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcttacttaggcggcgccggttgcagtga

SEQ ID NO: 1844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcttagaccagcatctcattgtggtgtct

SEQ ID NO: 1845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcttcatgttcaaagcttacttcccacgg

SEQ ID NO: 1846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgcttggttcggaacgaatatagtaaaggg

SEQ ID NO: 1847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggaaacgaagcgaagatctcatcgctaat

SEQ ID NO: 1848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggaaacgcgtcgggcacaaacgtcctcaa

SEQ ID NO: 1849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggaagatgcggctagcagaggacaagtct

SEQ ID NO: 1850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggacactgctgcgtaccgagaccccacgg

SEQ ID NO: 1851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggagagatataatcttagtctaggccggt

SEQ ID NO: 1852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggaggaacggatctcaatcctgatcggat

SEQ ID NO: 1853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggagggtgtcaattaaggtatgtggccgc

SEQ ID NO: 1854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggagtatggtgcatttaccgtgtgacgtt

SEQ ID NO: 1855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggatcgatggccggagctctgtatcaccg

SEQ ID NO: 1856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggatgatggatccagccaatccctatgca

SEQ ID NO: 1857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggatgcgagggccacagtcgtcatgaatg

SEQ ID NO: 1858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggcacgagttcggccctcacacatgcatt

SEQ ID NO: 1859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggcagcgcaatccacttggagctccgtcg

SEQ ID NO: 1860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggccgctttgcgcacgctagacctctacc

SEQ ID NO: 1861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggcgcgcttggacgtacaacgaatactcg

SEQ ID NO: 1862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggcgtcgcgcctgcgctatactctcatgg

SEQ ID NO: 1863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggctccggtcttcttacgttggacactcg

SEQ ID NO: 1864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggctcgtactttacctcttctcataacac

SEQ ID NO: 1865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggctcttgtatttactacgtgcaaaatag

SEQ ID NO: 1866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggcttatacagatggtatcgtttgcagcg

SEQ ID NO: 1867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggcttgtcatggtcccgaataacgggttg

SEQ ID NO: 1868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggacccacactgttaggccctttcgttc

SEQ ID NO: 1869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggccgcgtacgaaaggggttcaaatgtt

SEQ ID NO: 1870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggcgatcgcatacgacaagaagggttct

SEQ ID NO: 1871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggcgctcgcaagctgtgtctaaacgctg

SEQ ID NO: 1872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggctgccccgtctatcgactttgttgcc

SEQ ID NO: 1873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggctttttcccatgattgtctttcgggc

SEQ ID NO: 1874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggggctgtttccaagctttactgttttg

SEQ ID NO: 1875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggtgacatgctagtcgtaagagccctta

SEQ ID NO: 1876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggtggagcgccttatcagttcccttcac

SEQ ID NO: 1877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgggttgcactagtggcattggtgatactc

SEQ ID NO: 1878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggtctcgcgttgcgtgatctggaccgttg

SEQ ID NO: 1879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggtgccgatcggtggggtcgccggtcccg

SEQ ID NO: 1880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggtgccgcagtttccatcccaagggccct

SEQ ID NO: 1881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatggtgtcggaggcccgcttgattactttga

SEQ ID NO: 1882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtaaacgcagaattcgcggggaggtgagc

SEQ ID NO: 1883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtaagctctggtaccgatttagttgaggt

SEQ ID NO: 1884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtaagggcgccaatattccgccaacatag

SEQ ID NO: 1885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtacatcacaaagctatgttctcggccgg

SEQ ID NO: 1886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtacgcgcaattcaggcagtgtattacgg

SEQ ID NO: 1887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtacgcggatgtttgggattaagcgctta

SEQ ID NO: 1888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtacgtcgttgctcggtgatatggaatta

SEQ ID NO: 1889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtatcgtagccgggttttttgtctccaac

SEQ ID NO: 1890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtatgagttcatcttagggcgccgctgag

SEQ ID NO: 1891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcaaaccgatccgctgccatcccatcat

SEQ ID NO: 1892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcaccgtcagtgcacccttcctggcacg

SEQ ID NO: 1893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcacgcgttcacctctgtggtttctatg

SEQ ID NO: 1894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcacttttagaataattaccccctatgc

SEQ ID NO: 1895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcaggcttgtcgtacaactttggggctc

SEQ ID NO: 1896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcagttagatgggtggtcgagcagtaca

SEQ ID NO: 1897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcataccgtgcacttcagccttctcgtc

SEQ ID NO: 1898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtccacatcacacaagcttcgagtctccc

SEQ ID NO: 1899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcccccccgagtggtttctaggttcagt

SEQ ID NO: 1900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtcctccgtaacttccactcgttgcgtcc

SEQ ID NO: 1901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtctcagcagatttccctcacggttggaa

SEQ ID NO: 1902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtctctgttactgcgggggctgctattcc

SEQ ID NO: 1903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgacgcctaacagtacctagaatcggta

SEQ ID NO: 1904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgaggagatgcccccacctggtcactag

SEQ ID NO: 1905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgagttgtcgtaaaaactccggccacat

SEQ ID NO: 1906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgcaagtttcggtttctggtcaacgcta

SEQ ID NO: 1907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgcgcacggtcatttaaagttgacacca

SEQ ID NO: 1908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgctcagtagcgaaccacggacaactgg

SEQ ID NO: 1909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgctgttctcatgggcctcgcgatcggg

SEQ ID NO: 1910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtggaaggattgctgagctgcctgctttc

SEQ ID NO: 1911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtggtgacctgctatacggtaagtcgaaa

SEQ ID NO: 1912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgtgatagcctacggactcgctatagac

SEQ ID NO: 1913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgtgtgcggtttactgccctgcggtcctgc

SEQ ID NO: 1914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttatcacagacaggatggaggtgttccc

SEQ ID NO: 1915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttattgaggcaggtgatctttctggaat

SEQ ID NO: 1916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttattgcatcccgatcaggtgcaggaca

SEQ ID NO: 1917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttcgcgcccgtgtggtcagcatacggtg

SEQ ID NO: 1918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttgatccgtcttagttctgtgtcccgcc

SEQ ID NO: 1919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttgcggtcggcgacggtcaagtaaatcg

SEQ ID NO: 1920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttggaggagatgcccggagtgcatggct

SEQ ID NO: 1921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttgtgtagttcctcctggcttgacctcg

SEQ ID NO: 1922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatgttgttgcgtgtcgatcagtattatgcaa

SEQ ID NO: 1923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaaaagtcgtcagatgtgttctagtacgt

SEQ ID NO: 1924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaacagcagactttaccctactaacgggc

SEQ ID NO: 1925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaacggctcgttcgtgaggacttttgctc

SEQ ID NO: 1926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaagaccagtttcctttcgaccttctatt

SEQ ID NO: 1927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaatgtgaacgatatcacgaagggggtaa

SEQ ID NO: 1928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattacaggcaaagctagcctgtggcggaagt

SEQ ID NO: 1929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaccattcgggcagcttaatgttctctcg

SEQ ID NO: 1930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattacgtgggccaaactacctaattggtggc

SEQ ID NO: 1931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattactccgacacgttaccacgtaagcgtgc

SEQ ID NO: 1932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattactgcttcgaagcttaccaatctatgtt

SEQ ID NO: 1933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattacttcatggaacacactatggtcacatg

SEQ ID NO: 1934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattacttgtctccggggctcaggagtcatac

SEQ ID NO: 1935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattagacgttggacactcgcgtgttcaaaga

SEQ ID NO: 1936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaggaatacaagtcttaacacgctgatca

SEQ ID NO: 1937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaggaggatgctactggggggggctaatt

SEQ ID NO: 1938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattaggcagcagagccggagggatgcagtgg

SEQ ID NO: 1939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattagtgtgagaacggatgaggtgtgcgctg

SEQ ID NO: 1940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattatagattaacttacatacgttgtcttgg

SEQ ID NO: 1941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattatagcgttgagagtctggcgaggtagga

SEQ ID NO: 1942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattatcgtcctggctctttgctgttcaagtt

SEQ ID NO: 1943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattatgtccttgcccgcttgatatgtagtct

SEQ ID NO: 1944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcaacatcaattatgtagggttttcgcgg

SEQ ID NO: 1945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcaagccccgacagttggttgtgcaactg

SEQ ID NO: 1946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcactggaaccctgtcgagtcgggtcgat

SEQ ID NO: 1947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcccctaaacttaactctcatgtagctac

SEQ ID NO: 1948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcccttaaaagcaaataatactcatcatg

SEQ ID NO: 1949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattccgaagtttgcacaaacgccgtccgagc

SEQ ID NO: 1950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcctgtgcgtaaggatcttgggttgctcc

SEQ ID NO: 1951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattccttagagcgaattaaagtgttcgggtg

SEQ ID NO: 1952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcgacattttagcaactgcgaactttagc

SEQ ID NO: 1953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcgatcactgtgtatgcttaagagtactc

SEQ ID NO: 1954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcgatggtttagtatttgtgtcatctatc

SEQ ID NO: 1955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcgattaggcccgaggtcccacttactac

SEQ ID NO: 1956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcggattgcaatagatgacatttcttccc

SEQ ID NO: 1957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattcgtttttccctggattgaggccggtttc

SEQ ID NO: 1958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattctaaccccgtgcatatctcttgggctcg

SEQ ID NO: 1959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattctacttcaaccattcttccccttctttg

SEQ ID NO: 1960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgacgtgcgatttcctgtgccggcctaat

SEQ ID NO: 1961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgatgggctggcggcgtgtgcggtggccc

SEQ ID NO: 1962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcacgtggtgtgccgattgtggtacgtt

SEQ ID NO: 1963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcacttctacatctggtaagctgcattg

SEQ ID NO: 1964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcagacgcgtggaatgcgacagaacgtg

SEQ ID NO: 1965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcagcatcggcaactgtcacttagtgga

SEQ ID NO: 1966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcagccacatcgtcttaaccgcaaaccg

SEQ ID NO: 1967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcgagtttgtgttctgtgcagatcggga

SEQ ID NO: 1968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcgcacgcggtggagtatctgacccgtg

SEQ ID NO: 1969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgctcagccgattgtcccgggaaggcgcc

SEQ ID NO: 1970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgctcattgttgtggccgtttgtaaactt

SEQ ID NO: 1971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgcttagactagtgcaatatagttgacct

SEQ ID NO: 1972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattggaatcgttcaatccagacggcagcgtc

SEQ ID NO: 1973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattggaggagcggtcgttgtgtccagcattc

SEQ ID NO: 1974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattggcaggggtcctccctatgctaccgttc

SEQ ID NO: 1975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgggcccaagcgaagattagtcatgtgcg

SEQ ID NO: 1976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattggtaatttgccctgtgacccgttaattt

SEQ ID NO: 1977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgtggtacggttgtcgagctttaccctgt

SEQ ID NO: 1978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattgtggtaggttgggggttttaggcacata

SEQ ID NO: 1979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttaaaccacagtacacttcctcctgcgta

SEQ ID NO: 1980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttacaacgtgtgcgcaatcggtgagcttt

SEQ ID NO: 1981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttaccaacgcagctgcgatctaaccttcg

SEQ ID NO: 1982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttaccgcgtaaaggcgtgccatggtgtca

SEQ ID NO: 1983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttagattggctcatcgtcgttagttttta

SEQ ID NO: 1984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttaggagtctactgagtcatattagtagt

SEQ ID NO: 1985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttatggatgacagttcggtaccatcctct

SEQ ID NO: 1986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttcaccgcaacaaagtccgtccaacatgg

SEQ ID NO: 1987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttcacggtcgactcgcgcgggatttagac

SEQ ID NO: 1988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttcccggccgcgtgggcgtataatgaatt

SEQ ID NO: 1989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttccgaagctaattcattccttacgatgc

SEQ ID NO: 1990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttcgccggctgtcgtaattttacaattcg

SEQ ID NO: 1991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgcccttggcatggtctcaagggcccct

SEQ ID NO: 1992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgcgtccatgattacatcggtcccgtcc

SEQ ID NO: 1993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgctaggatcggggtgacgtattttgtt

SEQ ID NO: 1994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgctgccaatcctcgggttgccagaact

SEQ ID NO: 1995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgcttataacagttctcgcgccatctcg

SEQ ID NO: 1996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttggagtcttgggaattcgagcattggcg

SEQ ID NO: 1997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgggaatccaaggtttcgatccgtacgg

SEQ ID NO: 1998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgtatgcgacagacaacacatcagtttg

SEQ ID NO: 1999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgttaggtggtgttggccaaattcacga

SEQ ID NO: 2000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttgttattggcaacgagattgaggacctg

SEQ ID NO: 2001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattttcgactggtatcgttctctagatctcg

SEQ ID NO: 2002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aatttttgactcacgagtaccgcctacatctt

SEQ ID NO: 2003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aattttttcggataatgactggacggctgatt

SEQ ID NO: 2004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaacatgccagggcagcggaaagatgttc

SEQ ID NO: 2005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaaccagccccgtgaagcttttcttcgcc

SEQ ID NO: 2006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaaccgtcgcagactgtggggggcacggc

SEQ ID NO: 2007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaactactcggcggcttacctccacccgc

SEQ ID NO: 2008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaagaatccgagcataaatgttatctgtc

SEQ ID NO: 2009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaagtctggtgagactggtacctttattg

SEQ ID NO: 2010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaataagcgagtgcttcggtcgcggtgca

SEQ ID NO: 2011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaatctctacctttccaacctttcgagta

SEQ ID NO: 2012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacagatccaactctaaacgtttacgtgg

SEQ ID NO: 2013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacatgttacgcgatgggatcactcaggg

SEQ ID NO: 2014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacattttcctcacaagatgaggcagatg

SEQ ID NO: 2015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaccacgtcattaagggttgccccttctc

SEQ ID NO: 2016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaccgctccatgggttactatcgagcggt

SEQ ID NO: 2017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaccggtggggaaaattggctgtacgcgg

SEQ ID NO: 2018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacgaactatttgtagaattgcgaaaagc

SEQ ID NO: 2019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacgagacggtagccgtggcgccttgccg

SEQ ID NO: 2020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacgatgcgttcagaaggaactattagtt

SEQ ID NO: 2021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacgcggaaatatccatttcttatctcgt

SEQ ID NO: 2022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacggggttcctgggttcgctccagtggg

SEQ ID NO: 2023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacgtgttagttctagcatgcaatgttga

SEQ ID NO: 2024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacgttatttgagcggttccaacgttccg

SEQ ID NO: 2025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaactagagggggctgtaagtgtctgctga

SEQ ID NO: 2026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaactgctatgattcaaatgaactgagcgt

SEQ ID NO: 2027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaacttcgagcggcccaataggccgggctg

SEQ ID NO: 2028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaagaagactgcatgggcacgggagggaga

SEQ ID NO: 2029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaagatcgcgatctccggtttgttgttaac

SEQ ID NO: 2030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaagcactctggggggtccatgatggctcg

SEQ ID NO: 2031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaagcagttaaggtcgcgagagccgggttt

SEQ ID NO: 2032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaagctttatgtctttattgactgtttaac

SEQ ID NO: 2033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaggaacgcccgccaggaacccggcttgc

SEQ ID NO: 2034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaggattgtgtacgaccgtctacatcatg

SEQ ID NO: 2035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaggcacctttcgaacagtgggtatcatc

SEQ ID NO: 2036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaaggcggagcgacccgttgtgtgtttttg

SEQ ID NO: 2037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaagtttctattcgtatcttgcgtcacctc

SEQ ID NO: 2038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatagtcttgcagttcagcagtctagctg

SEQ ID NO: 2039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatcaaccgccaaacccgctcagtcctca

SEQ ID NO: 2040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatcatcaaagacttcttgtttgtttact

SEQ ID NO: 2041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatccgcaccatagtgtacccgcaagagg

SEQ ID NO: 2042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatccgtgcttctcctggcgacgccatat

SEQ ID NO: 2043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatcgggctggtaggctgcctgggagaac

SEQ ID NO: 2044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatcgtctccccgcaacgcccccaaagtc

SEQ ID NO: 2045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatctacggacagcgaagggtcggggccg

SEQ ID NO: 2046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatgcatgatccgctcaggtcgaaaggag

SEQ ID NO: 2047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatgcgccgcaccctgcaagctattagta

SEQ ID NO: 2048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatgcgctatggcctcgccgcgtgtcctg

SEQ ID NO: 2049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaatggacagcacgggcgattgtgagccaa

SEQ ID NO: 2050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaattatgacattacctattatctcggtgc

SEQ ID NO: 2051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaattgcgcgaatgtgatgcgtgttgcaat

SEQ ID NO: 2052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaattgggggttcacggttctttgtatgcg

SEQ ID NO: 2053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaattgtgtttctgcgtgtgctttaaagcg

SEQ ID NO: 2054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacaaagatggtcggttgcatgccgcggtc

SEQ ID NO: 2055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacaagcgaatccgcacttcacgcacgccc

SEQ ID NO: 2056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacacctgtggactccgtagaaccttttgg

SEQ ID NO: 2057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacagcacaccgttgcgtacgacgcggagt

SEQ ID NO: 2058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacattgcgccacatccctacggtgggtat

SEQ ID NO: 2059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaccaggaagtgcctaacgaattccgtaat

SEQ ID NO: 2060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaccaggtgccagacggagaatggcgccac

SEQ ID NO: 2061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaccattagattaatttgccaagatgtagg

SEQ ID NO: 2062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacccgcaaatcgacacccgagtggtgcgg

SEQ ID NO: 2063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaccgcgcacgacgggtccgaatttagcgg

SEQ ID NO: 2064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaccgctcacatgatcttgtgcatttgcat

SEQ ID NO: 2065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaccgtgctaaagttgttaaataggatgaa

SEQ ID NO: 2066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaccgtgctagttgaattatttgggactat

SEQ ID NO: 2067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacctacgtcagtaagaccatcactcctgc

SEQ ID NO: 2068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgacagctgtttcgtcagcgcttatggt

SEQ ID NO: 2069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgacagtgtgatgaggctagcacgaatc

SEQ ID NO: 2070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgacgtttaccgcattaaccagttacgc

SEQ ID NO: 2071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgactggaattggcagtcggttggaagt

SEQ ID NO: 2072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgatattatcggtgccggagaggtgtag

SEQ ID NO: 2073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgcaccggtgagctgttaacatcgcggt

SEQ ID NO: 2074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgcacggcatgtacgtaggtgaccgtct

SEQ ID NO: 2075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgcagcacccttaccaaacgcctgtaag

SEQ ID NO: 2076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgcgatatacggcggagcaggttgtgtg

SEQ ID NO: 2077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgcggatctatttgcagcagtggagggg

SEQ ID NO: 2078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgctcggattcagattgctcggtgtgga

SEQ ID NO: 2079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgctgcagaaccagacatttgccttaag

SEQ ID NO: 2080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgcttaagggcgggctgagatagtgggc

SEQ ID NO: 2081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacggattattctcttgacaacctccatag

SEQ ID NO: 2082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacggccctccttacgtcgccagcgtactt

SEQ ID NO: 2083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacggctgcaatacaggtgcgcggtgtcga

SEQ ID NO: 2084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacggcttggagtctgtctacccttgcttg

SEQ ID NO: 2085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgggagtgctctacgtcgtgggtgagcg

SEQ ID NO: 2086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacggtcggcgctcgcgtgggtcagaggtt

SEQ ID NO: 2087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacggtcttcgagactggtcaccggcgact

SEQ ID NO: 2088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgtaggtctatacaaaagtcggaatgcg

SEQ ID NO: 2089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgtagtggactttgcatttgtggcaata

SEQ ID NO: 2090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgtagttttactctttgaggtagtcgtt

SEQ ID NO: 2091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgtctgcgaggcggtcgggcagggggga

SEQ ID NO: 2092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgttcacactgcgcgggcgatctcacga

SEQ ID NO: 2093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacgttgtttcaggtcaccgttcttagctc

SEQ ID NO: 2094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaactcgcatcaatccaccagttcgtggtag

SEQ ID NO: 2095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaactcggcgacggcacgatacttcagttgg

SEQ ID NO: 2096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaactgctccgtacaagacttagcacttcat

SEQ ID NO: 2097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaactggcaattgcttgaccggcatttcgcg

SEQ ID NO: 2098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaactgtcgttggtgcccggcccgtagtcgg

SEQ ID NO: 2099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacttagggttgtgggaaggactgggcttg

SEQ ID NO: 2100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaacttcgggttaagttgcactttaatcgtt

SEQ ID NO: 2101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagaacggacgaccataccagcgcttgctg

SEQ ID NO: 2102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagaatttgcagcatgccacctctggaccg

SEQ ID NO: 2103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagacacgcagacgattgggacctggttac

SEQ ID NO: 2104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagaccagggccaggaggtactcgcggtag

SEQ ID NO: 2105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagacggtatgaggcagaagagtttcgtcg

SEQ ID NO: 2106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagacgtccgatcattgggtaatgaccttg

SEQ ID NO: 2107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagactcagagcacttacggatccgaacat

SEQ ID NO: 2108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagagaactcaggcgcaactggcgggccac

SEQ ID NO: 2109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagagtggaccgttcattgcgttgtattgg

SEQ ID NO: 2110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagataccgcttcaagtaggatcacagggg

SEQ ID NO: 2111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagatcagggggcgatgcgaggcgtaaccg

SEQ ID NO: 2112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagatcgcgggagtgcgattgttgccatgg

SEQ ID NO: 2113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagatcggtatgttcactgacgaacgtagc

SEQ ID NO: 2114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcaacttctgagaggcggatgcgaaggt

SEQ ID NO: 2115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcaatgaccgtaacgattcaaagactag

SEQ ID NO: 2116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcacgcagcgggccctaatcagacttcg

SEQ ID NO: 2117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcattagtgacttcctggttttggtcgg

SEQ ID NO: 2118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcctttattcgtagcggtggtgcggaag

SEQ ID NO: 2119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcgcttagtggctttttacagcagtggg

SEQ ID NO: 2120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcgctttatgtttcgcaccacggtataa

SEQ ID NO: 2121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcgtgccacagatggttctgcagagacg

SEQ ID NO: 2122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagctcgattactgtgtcatgtcccgcaaa

SEQ ID NO: 2123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagctgacgcaagcgggttcaaatgtttgc

SEQ ID NO: 2124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagcttttatgtgtctaccctataatgagc

SEQ ID NO: 2125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggaacttactgtctgccggacttttaca

SEQ ID NO: 2126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggaccaggacccacgtacaagatctgtg

SEQ ID NO: 2127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggagttggtgcttgctcggaacatacct

SEQ ID NO: 2128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggatgggacccgcgccccatgctggacc

SEQ ID NO: 2129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggcagacttcgaatcactttaaatgggg

SEQ ID NO: 2130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggcagtgtgtggatcccgggacgctttc

SEQ ID NO: 2131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggcccgaacagctggaattattgtctgt

SEQ ID NO: 2132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggccgagacgcaccaacacacttcactc

SEQ ID NO: 2133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggccgttaaggttgttttaagggggtgc

SEQ ID NO: 2134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggcctctgcaggcaggcggggcgaagga

SEQ ID NO: 2135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggcgctgagcatgcctatgttcccccga

SEQ ID NO: 2136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggctcagagcttacgctagctggctagg

SEQ ID NO: 2137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagggcaggctgggctccaacagatacagc

SEQ ID NO: 2138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagggccagttaaatcctcgaccagttggc

SEQ ID NO: 2139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagggcgttccatgggtagagatgaggtta

SEQ ID NO: 2140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagggggagctagactaggcttcacggcgc

SEQ ID NO: 2141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagggtgaaatctgaacttcggtcttccga

SEQ ID NO: 2142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagggtgtattgccgtgtggcggtttagag

SEQ ID NO: 2143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggtagctcaacctgccacgcgatcctcg

SEQ ID NO: 2144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggtcacaatcttcctcaaccacaactgc

SEQ ID NO: 2145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggtcgaaatctcaagtattcacgggcta

SEQ ID NO: 2146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggtcgcaacgagcgttcgcaatccagct

SEQ ID NO: 2147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggtcgttcactgataacccttcccgcgt

SEQ ID NO: 2148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaaggtgagggcgagggtatcccggcacaag

SEQ ID NO: 2149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtaacacgcttggccacagcccggtaat

SEQ ID NO: 2150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtacattcgaaaaacaaagggacgtaga

SEQ ID NO: 2151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtacggctctatatgggacacggcacct

SEQ ID NO: 2152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtcacctcgtggcagttcgaccaggctg

SEQ ID NO: 2153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtccaggatctgacgggactccgatgca

SEQ ID NO: 2154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtccgctgtgtaagtcgcagcaagtgcc

SEQ ID NO: 2155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtcttgtcttgctccatttacttcttag

SEQ ID NO: 2156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtgatgcgcccatgggatggcccgaacg

SEQ ID NO: 2157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtgcatgtagactaagtcagtacggggc

SEQ ID NO: 2158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtgcgagttcgtttttccctgagcagac

SEQ ID NO: 2159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtggcttggagagtggtggacgctggta

SEQ ID NO: 2160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtgtcggcctacacattcggagtcatgg

SEQ ID NO: 2161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagttggagggacccactcacccttctatt

SEQ ID NO: 2162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagttggggtaacatctcctggatcgtacg

SEQ ID NO: 2163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaagtttgcgggtcagtttctgcaatcgcgg

SEQ ID NO: 2164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaataagggggaagcctattatcgtttcggc

SEQ ID NO: 2165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaataattgcccggcagcttccgcatcccgc

SEQ ID NO: 2166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatacaaatccgaggtcttctttcagtcgt

SEQ ID NO: 2167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaataccatggagatcattggtgatgtgtgg

SEQ ID NO: 2168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatacgcaagtccccgggttgctgtagtat

SEQ ID NO: 2169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatacgggctctttctccccggacgttctg

SEQ ID NO: 2170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatacggtcaacgcctgggggggtacttcg

SEQ ID NO: 2171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatactcgaatcacgatcaggacttttcgt

SEQ ID NO: 2172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatagcccacacatcgttattaatgttgtc

SEQ ID NO: 2173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatagggaggaggcacgaggatagtctgtt

SEQ ID NO: 2174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatagtggtttcagtagctgtcatcgggtc

SEQ ID NO: 2175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatatcagtagaggcttggaccttacccca

SEQ ID NO: 2176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatatgagtccgcgactagacttgcaacgc

SEQ ID NO: 2177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatatgtgcctacttttgccccatcgtctg

SEQ ID NO: 2178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatatttttgggactcaacgggtattccat

SEQ ID NO: 2179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatcaaggcgaaacgtatggggaaggagcg

SEQ ID NO: 2180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatccagcacgttcctcgtgcgcatcggtc

SEQ ID NO: 2181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatcctcgggtacgcttgtattgaactctc

SEQ ID NO: 2182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatcctgaaggggagcgtgtgcagtgcccg

SEQ ID NO: 2183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatcgcgtttcacgggatgaagacgagcgg

SEQ ID NO: 2184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatcggaggccgggcagtaaggtgccgtgg

SEQ ID NO: 2185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatctccaaggatccgttccacaatggccc

SEQ ID NO: 2186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatctcgacatataattgtgtatatttgcg

SEQ ID NO: 2187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatctcggcgcagggacaatttcatccggt

SEQ ID NO: 2188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatctggtgtctctggctggctcgcatagg

SEQ ID NO: 2189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatgaactcgtcgattccttacattatccg

SEQ ID NO: 2190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatgaggagcaaagctcaatgctaagcccg

SEQ ID NO: 2191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatgccaggcatcctttgggtagttccgtc

SEQ ID NO: 2192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatgcgaagagtaggcgaaacggcggcttg

SEQ ID NO: 2193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatggaaagtatagatgttacatcgtgagg

SEQ ID NO: 2194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatggcagggtcagagctcaggctctaatg

SEQ ID NO: 2195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatgtattcgattgtaatgtgtagatgccc

SEQ ID NO: 2196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattagccggtaaaataggttttgcaaaag

SEQ ID NO: 2197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattcggcgactacttctgaattgccgcgc

SEQ ID NO: 2198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattctcggtaactggggtctgcgtgttct

SEQ ID NO: 2199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattgacggcaatatctgaggggcagccgg

SEQ ID NO: 2200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattggttggaaacttggcttaggccggca

SEQ ID NO: 2201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattgtgggaggacggcgacgatgattgca

SEQ ID NO: 2202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattgttcgagctgacgtttcccccagttg

SEQ ID NO: 2203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaattgttggtcaatgtgtgtgtggtcttat

SEQ ID NO: 2204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatttcaagccctcagacagtactaactag

SEQ ID NO: 2205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatttcttggttgtatttaaggggtatgat

SEQ ID NO: 2206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaatttgtcctggcccagaggtcaggtccta

SEQ ID NO: 2207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaaaaatgaccacggtacttgtgcgatct

SEQ ID NO: 2208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaaaccagtttccaggatgttacgatgtc

SEQ ID NO: 2209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaaagacctcttcggttgcatgggggatt

SEQ ID NO: 2210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaaagctcgcgcggagacggtgtgcgggg

SEQ ID NO: 2211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaacaatttccagccaggcttaaattccg

SEQ ID NO: 2212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaacacgaattgaacgtgttttctcagga

SEQ ID NO: 2213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaacatcgagtgtaattcttcgctccacc

SEQ ID NO: 2214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaacgtcaagagtgcgccaataaatggat

SEQ ID NO: 2215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaactcgtgatgcacggtacttttgctgc

SEQ ID NO: 2216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaactgtcagtgtatgatgggtgcactcg

SEQ ID NO: 2217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaagcgaggtcaatggctcgcacctcttg

SEQ ID NO: 2218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaagttggacctccgtaagggatctcttc

SEQ ID NO: 2219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaatatcaaacccacagcgacgttcgccc

SEQ ID NO: 2220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaatggacggggggtccctcaacgatccg

SEQ ID NO: 2221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacaacaagcgactaaggttgaaatcctc

SEQ ID NO: 2222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacaagttctggtgggtgcccgccttttg

SEQ ID NO: 2223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacacgggtcctcaacttcggcattactt

SEQ ID NO: 2224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacactttttaacgttgtccactacttag

SEQ ID NO: 2225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacaggcgggacgcgccgttctttccgta

SEQ ID NO: 2226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacagtaagatcactgcggccggcggggc

SEQ ID NO: 2227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaccgcgacccccgggtaacggctcatga

SEQ ID NO: 2228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaccgctaagccagcacggtcttgtgtat

SEQ ID NO: 2229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaccgtaaattgggcttcccgtcaagtag

SEQ ID NO: 2230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacgacttctccgtacgggggttagtata

SEQ ID NO: 2231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacgcttttcggttgctatcggtagtttg

SEQ ID NO: 2232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacggattatactaaatgggttccagtcg

SEQ ID NO: 2233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacggcgcctagacctggcttaccgctag

SEQ ID NO: 2234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacgggaggcatcgtatctgattgtattg

SEQ ID NO: 2235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacacgttccacagtatctaagggccttttt

SEQ ID NO: 2236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacactcggcaggacggcaccaacatctgtg

SEQ ID NO: 2237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacactgggggcgttcacgagattgtcacaa

SEQ ID NO: 2238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacactttagggtctgcggactctgtatgtt

SEQ ID NO: 2239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagaagccgtgccagtcaccgattagtac

SEQ ID NO: 2240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagagaatccgcgcagggatccgcttact

SEQ ID NO: 2241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagagtgcggattcctttaacgggtcaca

SEQ ID NO: 2242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagccaggtgccgagcggttgggattttg

SEQ ID NO: 2243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagccagtgaattatttccttgctgcctc

SEQ ID NO: 2244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagcccctacgcgttgttccccgtgtcgc

SEQ ID NO: 2245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagctgaagagatagggttatgtgtcccg

SEQ ID NO: 2246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagctgcacgagacgccacgcattagtcg

SEQ ID NO: 2247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaggaggcaaaacacacagtctttgacct

SEQ ID NO: 2248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaggcaaactcagaactctggtgcagtta

SEQ ID NO: 2249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaggcaccaaccgaacaacaagccggttt

SEQ ID NO: 2250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaggcatggtgatatcttcacgaccagcg

SEQ ID NO: 2251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaggctcttgacatggcaacgtaggtccc

SEQ ID NO: 2252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaggggtctgacctctcgcagcttcaaac

SEQ ID NO: 2253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacaggtggagggcttctttgcgcttggggg

SEQ ID NO: 2254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtatcgatcgacactgctagcatattc

SEQ ID NO: 2255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtattattcatgttaactgcctaatgt

SEQ ID NO: 2256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtcgcgagagttcacgtgcctgcgttc

SEQ ID NO: 2257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtctcatccgcatagatgtaattggtt

SEQ ID NO: 2258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtgatcatcgatcgtattgttgggtat

SEQ ID NO: 2259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtgccacaagggagaagacgaatggag

SEQ ID NO: 2260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtggtatagtacggtcagtccctctac

SEQ ID NO: 2261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtgtaaaaggatcaaggatgaggctag

SEQ ID NO: 2262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtgttatataccaacccagctcactgg

SEQ ID NO: 2263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagttctacccccggctttgaaggatgtg

SEQ ID NO: 2264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagttgctaaaagacatggtgacccgtgg

SEQ ID NO: 2265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacagtttgtcagttacaacatcaggtccgg

SEQ ID NO: 2266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatagcggagcgtgccacctcgtgtatgc

SEQ ID NO: 2267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatatacgctgcccgtggcgagtgcgctg

SEQ ID NO: 2268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatcactaatctcaaaggcggcttatccg

SEQ ID NO: 2269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatcctgccatgggccgggcacttgtcgg

SEQ ID NO: 2270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatcgagtccgccttgtattctatggtgt

SEQ ID NO: 2271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatcgatttcatgtcacaccacaggccca

SEQ ID NO: 2272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatcgcctttgtgctaaaggaaaaaactc

SEQ ID NO: 2273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatctcggtttgcgttcgctgacctggct

SEQ ID NO: 2274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatgaaccactctgtcattcccatgggag

SEQ ID NO: 2275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatgacagccagtcggttggtcttgtggg

SEQ ID NO: 2276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatgcactccggaacatctctccgcgagg

SEQ ID NO: 2277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatgcgactcatttatgtgtaatttctac

SEQ ID NO: 2278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatggcgcgcggtttctgttgcaccttgg

SEQ ID NO: 2279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacatggctttctaatgtgctagactaccgc

SEQ ID NO: 2280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacattgaatgaacgggaccggcttcttgcg

SEQ ID NO: 2281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaaacggtcacttatccgagctgttgat

SEQ ID NO: 2282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaacacttgactattctcgtgttactag

SEQ ID NO: 2283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaacagcgaacggtaagctgtggcgacg

SEQ ID NO: 2284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaaccccgcaaacttttgaagagtagca

SEQ ID NO: 2285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaagaatgctccgagtctgtccgttatt

SEQ ID NO: 2286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaagtggataagggctcaaatccccgcg

SEQ ID NO: 2287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccacacaatgggaccatactgggctgtgc

SEQ ID NO: 2288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccacactagggaatatatcaaaatgtctg

SEQ ID NO: 2289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccacagagggtagactgttgcctcgtgta

SEQ ID NO: 2290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaccagtacatgcagactattcctatta

SEQ ID NO: 2291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccacgctgcaggtttctagcgaggatcaa

SEQ ID NO: 2292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccacgggaatacaagacaggcgagtctag

SEQ ID NO: 2293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccactcgcacggcactatccacctttctg

SEQ ID NO: 2294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccacttggttacttttcgagtggctaagg

SEQ ID NO: 2295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccagctcctggacattgattacttattca

SEQ ID NO: 2296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaggcaccagtctcactcacctctcgtc

SEQ ID NO: 2297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccaggccaatagtaatatccacggtccgg

SEQ ID NO: 2298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccatatccccggcagtcttccgctgctgc

SEQ ID NO: 2299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccatctgaggcgacccaaaatcgcacagt

SEQ ID NO: 2300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccatggcagttagttcgacggtgcgcgcc

SEQ ID NO: 2301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccattaatttgtgggacactgggggaagc

SEQ ID NO: 2302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccaacctgatgcgttaggtggcgtgcgc

SEQ ID NO: 2303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccacgtccgatctcctggggtgtgcgtt

SEQ ID NO: 2304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccagaccgaacttacagaacaagactga

SEQ ID NO: 2305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccatgctctagatgaactaggctgcatt

SEQ ID NO: 2306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccccacgcctaacaacgggacttctcatg

SEQ ID NO: 2307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccccatcagcgtgagtcagtcgcttcgcc

SEQ ID NO: 2308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccccatctgggtcttcaacgtccctttgc

SEQ ID NO: 2309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccccctatgctcacgtacgggttgatctt

SEQ ID NO: 2310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccccggacgtacgccgccaggccactccc

SEQ ID NO: 2311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccgctcgagtacgttccgctattttcgg

SEQ ID NO: 2312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccggacagcttaggggagtcagggtgga

SEQ ID NO: 2313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccgggttgtgtgtcaagcgaatcgacag

SEQ ID NO: 2314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccctgagtaccctacattcgctgccttgg

SEQ ID NO: 2315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacccttgtcgacttttgctctctgaggcgt

SEQ ID NO: 2316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgacatcagttaagaatagtacttgtaa

SEQ ID NO: 2317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgagaggggacacgggccacgaccaggc

SEQ ID NO: 2318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgagtcggcacggaaccggatacggagt

SEQ ID NO: 2319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgattcactaggtatctcaatatttacc

SEQ ID NO: 2320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgcacggtgagcatgcttgaactggtat

SEQ ID NO: 2321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgcatcacgctcctgttcccccgtcatg

SEQ ID NO: 2322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgcggcccgtgatcaacgctggctatgg

SEQ ID NO: 2323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgctgggctctttagcaagtatgtcggt

SEQ ID NO: 2324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgctgtcctacccctaaggtacattggg

SEQ ID NO: 2325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggaatccgcacaggcctgtggtggacg

SEQ ID NO: 2326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggatgtttaactcaagcctgtgcaggg

SEQ ID NO: 2327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggattgcggagatgtgggatcatcctc

SEQ ID NO: 2328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggcaggcatttggcctcagtccagacc

SEQ ID NO: 2329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggcgataaagggcggtgcggtcccccg

SEQ ID NO: 2330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggggacagtgatcgcgccagtcgatca

SEQ ID NO: 2331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgggtcagctggacctgtgtttaccttc

SEQ ID NO: 2332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggtcataaaggtgcatatttcgcctgg

SEQ ID NO: 2333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccggttatgacgggtcagcatgtgctgta

SEQ ID NO: 2334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgtgacgagcacttttctttcttaagtg

SEQ ID NO: 2335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgtgatttggttatgaggataagcaggt

SEQ ID NO: 2336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgtgctttggcctaccatatgttccctc

SEQ ID NO: 2337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgtgtgcgaatgatctacagttctcctt

SEQ ID NO: 2338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgttcgatcgcccaattcggttctccgg

SEQ ID NO: 2339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaccgttttcaccatcaaagatcagcaaagc

SEQ ID NO: 2340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctaaggtaagggtgcttagtacttgcgg

SEQ ID NO: 2341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctcaacggctcggtggcatcggaatgaa

SEQ ID NO: 2342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctcccttgcggctgccgtgcttggcctt

SEQ ID NO: 2343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctccgatcggggacgggatgtctaacac

SEQ ID NO: 2344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctccgccaggccctcaatcgtttagtcg

SEQ ID NO: 2345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctcgccgtcatcggtgcaaaggcgggga

SEQ ID NO: 2346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctcggcggtaacggtggttctgttgttt

SEQ ID NO: 2347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctcgggacccacaatagggcgtgcgagc

SEQ ID NO: 2348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctcgtcgtctatgaacccactgtacgtc

SEQ ID NO: 2349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctgacctgtcactgctctgcgttcgagt

SEQ ID NO: 2350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctgatctctttaagcttttacgatgtcg

SEQ ID NO: 2351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctgggggtatatgtaaagtatgagcttt

SEQ ID NO: 2352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctgggttatgtatccaagattaggtcgt

SEQ ID NO: 2353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctggttacttttaatcactggtgacacc

SEQ ID NO: 2354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctgtttagcatagttctgtctttttcgg

SEQ ID NO: 2355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacctgtttctgatctgttggttttatgggt

SEQ ID NO: 2356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaaaaccttatcgtggggggatgccaca

SEQ ID NO: 2357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaaacacagcaacatccgcgcaccacct

SEQ ID NO: 2358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaaaggctactgattcgagtacgcgctg

SEQ ID NO: 2359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaacatggggccgatcgtggggcatgag

SEQ ID NO: 2360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaaccaggttccatttcggtggtaggtg

SEQ ID NO: 2361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaaggatgcgtacatcacgatttcgatt

SEQ ID NO: 2362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaagtgacgccgcgcttgtgttgtccga

SEQ ID NO: 2363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaatgtggatactccctcctgtgccgtg

SEQ ID NO: 2364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgacatcacactttgcaaaccgtgcgcac

SEQ ID NO: 2365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaccaccacctgcttatcatttacgcgc

SEQ ID NO: 2366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgacccgtatcaagcgaaatagcactagg

SEQ ID NO: 2367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaccgcccttacgcttcgttgagttctc

SEQ ID NO: 2368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgacgtcgtatataggccgtctaggggcc

SEQ ID NO: 2369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgacttgtgttccctctgctcttgtacgg

SEQ ID NO: 2370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgagaaccatagacttgcgctgaggggcg

SEQ ID NO: 2371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgagactagcggtcttctactctcgcagg

SEQ ID NO: 2372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgagagctaaccttaatctgtcgtacctc

SEQ ID NO: 2373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgagccagtgttcgcggttatattcatgg

SEQ ID NO: 2374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgaggtaagctatcagtgtggtgttgctt

SEQ ID NO: 2375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgagtgctcagataatgatccggcagacg

SEQ ID NO: 2376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgatagcagagggaatccacatttgtgtc

SEQ ID NO: 2377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgatagtcgacggtgcacgttagtccatc

SEQ ID NO: 2378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgatctgcctgttcgcgtaatttgcatgg

SEQ ID NO: 2379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgattcagcgtcgacttcgccatttcgcg

SEQ ID NO: 2380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgattgaggcggtgttcatctcacatgtg

SEQ ID NO: 2381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcaagaagttttccgttcaaattagcgg

SEQ ID NO: 2382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcaatgtggtaactcaagcccccctttg

SEQ ID NO: 2383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcacctcggagggtcgtatttctaccgc

SEQ ID NO: 2384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcacgatctcagaaggtagacgagggac

SEQ ID NO: 2385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgccacgctggcatgatctacccctctcg

SEQ ID NO: 2386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgccactcacaatagggctgcggctaaag

SEQ ID NO: 2387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgccccccagagttgacagcgtgggtttg

SEQ ID NO: 2388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgccgacgtatcttcatctaggaatatgc

SEQ ID NO: 2389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgccgattcccagcgggggaaacctcccc

SEQ ID NO: 2390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgccgccgttttgggccatacgcgaccga

SEQ ID NO: 2391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgccgtcgttacgttaacgattgttatcg

SEQ ID NO: 2392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcgactacacttcatgcgtaagaatttc

SEQ ID NO: 2393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcgatgtaggaagtctcggtcttttagt

SEQ ID NO: 2394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcgcgcccgtttactaacacattccatc

SEQ ID NO: 2395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcgctcttgtggccggtttttcaaggaa

SEQ ID NO: 2396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcggaactgtgggactatatttgatctg

SEQ ID NO: 2397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcggaagtcacgcatctgcagtatttgg

SEQ ID NO: 2398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcggcagctcaaggggttgccatctcac

SEQ ID NO: 2399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcggcggttggccaggaagtggagattg

SEQ ID NO: 2400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcgggcacgttggatctaccatgcttac

SEQ ID NO: 2401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgctaattgcatgaacgctccaaatacgg

SEQ ID NO: 2402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgctggattagccattcccgaagatgtcc

SEQ ID NO: 2403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgctgggacgactgggccctgttgttggg

SEQ ID NO: 2404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcttatgatgagttgggcctaactcagc

SEQ ID NO: 2405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgcttctctcggtgacggtcattatatcg

SEQ ID NO: 2406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgctttcaatcagggggcgttctctggca

SEQ ID NO: 2407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggaattgacttcttggcatctgggcttt

SEQ ID NO: 2408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggacatcccgccaatcggtatggcgtct

SEQ ID NO: 2409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggacgacagaggggaagtgcactgcttt

SEQ ID NO: 2410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggacgatggagtcatgcactttcgctag

SEQ ID NO: 2411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggacgattttgcgcgcacggttttttgc

SEQ ID NO: 2412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggagccgagtcaactctttacagcgggg

SEQ ID NO: 2413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggccgctctgctataccgccaatgtaca

SEQ ID NO: 2414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggccttccgatgaaggtgtcgccagccc

SEQ ID NO: 2415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggaaagagacgcttgactgcgggaggg

SEQ ID NO: 2416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggcacggtgggttaagtatacgccaag

SEQ ID NO: 2417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggcacttttcagtgtgtcttagggact

SEQ ID NO: 2418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggcagccagaaatcgtcacgacccccg

SEQ ID NO: 2419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggccctgggaatgtctgccaccggggt

SEQ ID NO: 2420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggccggtgtttgctgtatgggtattag

SEQ ID NO: 2421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggccttcttggcacgagccatggggct

SEQ ID NO: 2422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggggaacaggtaactggacagtcttcgc

SEQ ID NO: 2423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggggcgctagagtgggcgaccgtttgaa

SEQ ID NO: 2424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgggggacgccggcaatgcacattgcgat

SEQ ID NO: 2425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggggtcttcattacgcatttcagagcaa

SEQ ID NO: 2426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggtagacggccccttgcgatgtggtgac

SEQ ID NO: 2427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggtcagatgctttgagtattttgtaagt

SEQ ID NO: 2428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggtcggcgtaactaacgaccgggcaaaa

SEQ ID NO: 2429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggtgcgtgtgttaagctgatggcatcgt

SEQ ID NO: 2430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggtgtgacatgctaatactgatcaactg

SEQ ID NO: 2431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacggttcggcgtacataacctcgcgtgtgt

SEQ ID NO: 2432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtaaccacgggggtttccgcatcagagc

SEQ ID NO: 2433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtatgttgcatacctctccagaaggcgc

SEQ ID NO: 2434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtcacttgccacagtcggtctagatctc

SEQ ID NO: 2435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtcagtatcggttgagctacttccggct

SEQ ID NO: 2436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtccgacaaatctcccctgctcgcgtcc

SEQ ID NO: 2437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtccgcccagttgcacttctggcagccc

SEQ ID NO: 2438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtcggactcgtcctgacttatcggctga

SEQ ID NO: 2439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtcgtacctgcttgtcccggataccgtt

SEQ ID NO: 2440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtcttgccccgatctacttatgttttcg

SEQ ID NO: 2441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtgcacatctctcgatctatacccgggt

SEQ ID NO: 2442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtgcaggtaagcacctcatccttcgtcg

SEQ ID NO: 2443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtgcgcctgaccgctctcgtttcggggg

SEQ ID NO: 2444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtgcggttgagctgggggaggcttggac

SEQ ID NO: 2445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtgtcggtttggtttagatcgcttcatg

SEQ ID NO: 2446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgttatgactgtaccggctcgcgtatatc

SEQ ID NO: 2447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgttcgaaccttccgtatgtagattaaac

SEQ ID NO: 2448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgttcggctatagtaggaccaccctgacg

SEQ ID NO: 2449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgttgcagagttccggttcgacttaagtc

SEQ ID NO: 2450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgttggatattgctcttgaggattggtgg

SEQ ID NO: 2451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgttggccaccagcatgtcgtcagcgttg

SEQ ID NO: 2452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacgtttgtggttgacgcgcgagagggattc

SEQ ID NO: 2453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactaacaggcgctaggttgagttatgcggc

SEQ ID NO: 2454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactaagcttgacatggatggtgctttttat

SEQ ID NO: 2455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactaataaagtcgttaatcgcaacttggag

SEQ ID NO: 2456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactacaggcagtgggtcggtaccaagcagc

SEQ ID NO: 2457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactacggctatgtcacgacgatatctgatc

SEQ ID NO: 2458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactactttagagcaggactagtgccggcac

SEQ ID NO: 2459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagagagctcacccggggtgaaatgctt

SEQ ID NO: 2460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagcgcactgtcattaatataagggccc

SEQ ID NO: 2461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagcggaagtcctgtaacgtgtctacgc

SEQ ID NO: 2462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagcttacagatgcggtggttggttacg

SEQ ID NO: 2463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactaggacgggctcgctgtagctagttagc

SEQ ID NO: 2464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactaggtgactgccaaatccgagggcgcca

SEQ ID NO: 2465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagtcccagacaacttatagccgcactg

SEQ ID NO: 2466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagttacggttgccggacgcgttttccg

SEQ ID NO: 2467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagttcgccttgaggttcgcgccggccg

SEQ ID NO: 2468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactagtttagggtatgtaacattgagaaat

SEQ ID NO: 2469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactataaaagcttaattcagagagtccaga

SEQ ID NO: 2470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactatcactatgaagttattatgatcccgt

SEQ ID NO: 2471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactatcggcgacaaactgcatgagggacga

SEQ ID NO: 2472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactattcggcctaactcgatctgcggccac

SEQ ID NO: 2473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactattggacgtgtattttatcctaagctc

SEQ ID NO: 2474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcaacagacgttcaccgactacagcttt

SEQ ID NO: 2475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcaataacctgagtcattcaattgtaac

SEQ ID NO: 2476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcaattacccgtgatagtgccctagtcc

SEQ ID NO: 2477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcacattttccagtctagccaggccccg

SEQ ID NO: 2478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcacttaaaggtcttctaggtatttctt

SEQ ID NO: 2479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcatctgcggcgctagtggccatagttt

SEQ ID NO: 2480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcatgcactagttcccatgccctcttgc

SEQ ID NO: 2481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcccaggattggtcagctcgatgggtgt

SEQ ID NO: 2482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcccccgtgagccgatggcccgttatgt

SEQ ID NO: 2483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactccgattgatgtgacaactgggggtttg

SEQ ID NO: 2484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactccgcgacatcccggtatcatttggtgt

SEQ ID NO: 2485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcgccaacaacaggccgctacaattccg

SEQ ID NO: 2486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcgtctctcgttgttacatccaattctc

SEQ ID NO: 2487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcgttgtccagcgcgggaagcatgcggc

SEQ ID NO: 2488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactctagtcactctcggcaacagcgagcat

SEQ ID NO: 2489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactctcgcgatgaacgaaggtaatcgccgt

SEQ ID NO: 2490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcttactagttcttctggtcaggacacg

SEQ ID NO: 2491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactcttgtaccatgctggattgaagtattt

SEQ ID NO: 2492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactctttattgtagccatggggggtgaaac

SEQ ID NO: 2493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgagataattgtaatgcgattaatgccc

SEQ ID NO: 2494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgagctcgcgagcatctccgggggcatt

SEQ ID NO: 2495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgatctggtcattcagctgctgccctgg

SEQ ID NO: 2496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgatgtattgcatgctcattcatcgaac

SEQ ID NO: 2497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgcccaggtgaagaagagtcatgagccg

SEQ ID NO: 2498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgcgaggcacgcaatatcctcacggttt

SEQ ID NO: 2499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgcgcacctaccaggaaattccgactcg

SEQ ID NO: 2500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgcgccactcgcgttataagtcgcctcg

SEQ ID NO: 2501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgcgcgagacggcttgggtttggactgc

SEQ ID NO: 2502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactggactaactccaaaccactcacacaag

SEQ ID NO: 2503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactggctacactcgttcggctatggtggga

SEQ ID NO: 2504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactggctagaagacacccgaccgtctaggg

SEQ ID NO: 2505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgggccttctgtcgttcttggagggcct

SEQ ID NO: 2506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgggctagtggggtacgtcaattgggcg

SEQ ID NO: 2507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactggggcggtacatggtcgtgcagtctcg

SEQ ID NO: 2508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgggttcgcttgctgctgagttaccggt

SEQ ID NO: 2509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgtagatgaaatcctttttccttgccac

SEQ ID NO: 2510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgtcgaacgaatcgattttctcgcggtt

SEQ ID NO: 2511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgtgcattttcgacgtagttccgttggg

SEQ ID NO: 2512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgttcctggcggtccctcgatccaggtg

SEQ ID NO: 2513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactgttgacacgcttggttaacgacatggc

SEQ ID NO: 2514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttatgttcctttacgctcgatgcggtcg

SEQ ID NO: 2515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttccatatggaggcggaggtgtagtctg

SEQ ID NO: 2516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttcgaatagacgcgtacaggtgatctgg

SEQ ID NO: 2517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttcgacaggtgttagctaatatgtcgat

SEQ ID NO: 2518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttcgctgggccggagggtctggaggggc

SEQ ID NO: 2519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttgagcgtcttcttccttcctaagtacc

SEQ ID NO: 2520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttgcactgataggaagccacgtcgtccg

SEQ ID NO: 2521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttgggttacgtttacgagtgtgagtcac

SEQ ID NO: 2522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acacttgtaccaatctgtggacctactcgggg

SEQ ID NO: 2523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactttaatttccatttcatttcatatccca

SEQ ID NO: 2524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acactttatagtccgtcccgacgtgccggtga

SEQ ID NO: 2525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaaagcactagcgccggccaacggaacgt

SEQ ID NO: 2526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaaatcccagcggccaaccgagggatctg

SEQ ID NO: 2527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaacctcctggacacattatgtcgggcat

SEQ ID NO: 2528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaacgaagtcattccgggtacgccagcta

SEQ ID NO: 2529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaacggattggatttctcattatttagac

SEQ ID NO: 2530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaacggcatgttgagggtaggcaatagcg

SEQ ID NO: 2531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaagcagctgcgtgtgatggttggcgttt

SEQ ID NO: 2532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaagcgacattccgggcaaaagaccgggt

SEQ ID NO: 2533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaagggtggcccgaggcactgacatagct

SEQ ID NO: 2534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaagtggtgcggtactttggtttgctgct

SEQ ID NO: 2535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaagttcggcggcgcgaggtgcatgtttg

SEQ ID NO: 2536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaatcttacgtcactgggggctcttggca

SEQ ID NO: 2537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaatgtgtaacgcgtttggagctaccgaa

SEQ ID NO: 2538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaatttgtacaacgtttccggtcgctctg

SEQ ID NO: 2539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacaatccacacctagcgtttattcctaa

SEQ ID NO: 2540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacacaaaacggaaatccggcaagtagct

SEQ ID NO: 2541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacacgcggttatgggcttcacctgaatt

SEQ ID NO: 2542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacacgcttatcggaaccaagcgccgtac

SEQ ID NO: 2543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacacttagatcaaatggtttggctttcc

SEQ ID NO: 2544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacagccccaggtacctttgccggatgtt

SEQ ID NO: 2545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacagcccgaaagaagatccgttcgttct

SEQ ID NO: 2546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacagggagggcagctaacgcgggtgact

SEQ ID NO: 2547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaccaaagacgagatggccccctttgcac

SEQ ID NO: 2548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaccattgccgaacaacagggggggtgcg

SEQ ID NO: 2549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacccgcgcgttcggtttccttgcacact

SEQ ID NO: 2550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacgaagcgttgggtaggattggggtgtg

SEQ ID NO: 2551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacgacaccacaggcgattacgcaagtcc

SEQ ID NO: 2552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacgccccgtgtccgactacacagcggag

SEQ ID NO: 2553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagactactacacctcgaccgggggattgta

SEQ ID NO: 2554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagactagaagcaattatacatagcgaggag

SEQ ID NO: 2555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagactcaggctagccgtgaggtaacgcact

SEQ ID NO: 2556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagactctcgcccatcccccggacatcgata

SEQ ID NO: 2557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagactgtcaaccgggtttgtgctgatctcg

SEQ ID NO: 2558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagacttcttcaatgcgtaccgttgagccca

SEQ ID NO: 2559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagacctaagatgatcacccctggtttcc

SEQ ID NO: 2560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagagggtcttctgctgagattgttgtag

SEQ ID NO: 2561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagcatcctgcaagtgtagtaccgatgac

SEQ ID NO: 2562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagcatggagcagttgacactccaacgtg

SEQ ID NO: 2563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaggaacaaccacttggtctactccgtac

SEQ ID NO: 2564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaggccgacctgaacttttaactgtttct

SEQ ID NO: 2565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagggatgtttgtatatcataggatagat

SEQ ID NO: 2566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagggcggctgagctaattccgggggtcc

SEQ ID NO: 2567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaggggtcgttccgcatgcttcgaaacgc

SEQ ID NO: 2568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagggtcaacttgcaagtcttcctcccat

SEQ ID NO: 2569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagagggtcagccaaccgttgggtcagctaa

SEQ ID NO: 2570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaggtcaggcctaacgggtgggtgcgaac

SEQ ID NO: 2571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagaggttttaagtaagggttttgttataag

SEQ ID NO: 2572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagataaaatgctggtttacattagcgatat

SEQ ID NO: 2573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatattaccagtttggagccgcgtgctat

SEQ ID NO: 2574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatccctagggcaccataacacttcatga

SEQ ID NO: 2575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatcgcagcataaggtgccttagatacgc

SEQ ID NO: 2576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatcggctttcaacgctgggcggattctg

SEQ ID NO: 2577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatcgtcaacgctattgtacctgccatct

SEQ ID NO: 2578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatgaagggactcccgcaacagattgtgc

SEQ ID NO: 2579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatgaattttcctgaaatgcgtgattctg

SEQ ID NO: 2580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatgcaccacgttccaaatgggttcggtg

SEQ ID NO: 2581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatgggcgagatgatgcacagtttcgttg

SEQ ID NO: 2582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatggtcagatccggtagctatgcctacc

SEQ ID NO: 2583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatttaataatatgccggtctgcccgtac

SEQ ID NO: 2584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagatttgttttcggcgagaagagcgagtaa

SEQ ID NO: 2585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaaacagcgaggtcagccttagcgtggc

SEQ ID NO: 2586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaaaccccacgtacttcgctatgttggt

SEQ ID NO: 2587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaaacggtgcgcgatcttggggcgtgac

SEQ ID NO: 2588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaacccaataagctagggcgaaggcgaa

SEQ ID NO: 2589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaagatgtccagggaatcccacctgggc

SEQ ID NO: 2590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaagcaggatactttgacgactgatacg

SEQ ID NO: 2591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaagcttgttacaatgcgcgaaaactgg

SEQ ID NO: 2592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaaggtggctgccctgatacagaggcgc

SEQ ID NO: 2593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaatcatgagataagggctcgagcggtg

SEQ ID NO: 2594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaatggccactgtggtgatgccaggctg

SEQ ID NO: 2595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaattaaatatgttgagatttgggagac

SEQ ID NO: 2596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcacaacgccattaaaggcactgtttctt

SEQ ID NO: 2597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcacaaggcaagtgcaatcgcacccatgc

SEQ ID NO: 2598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcacccgttcgtacctcgacccgccagtt

SEQ ID NO: 2599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcacccttgcccactggggtttagaccgc

SEQ ID NO: 2600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcacctgtaaaccgattactccacaggct

SEQ ID NO: 2601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcacgggtcattgaggttttgtgtttagg

SEQ ID NO: 2602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcacttacaccgtcgacgaagcgagaccg

SEQ ID NO: 2603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaggcattgacatatgtatcgggggctt

SEQ ID NO: 2604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcaggccggatacgccgtgtgctcgccga

SEQ ID NO: 2605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcataatgcgggggggatcgtctagccca

SEQ ID NO: 2606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcatacgacaaacgtgttaacgactacgg

SEQ ID NO: 2607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcatcgctttgggaacttaggagtggtcg

SEQ ID NO: 2608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcatggacctgtgcggtctcgtcgctccc

SEQ ID NO: 2609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcatttcggtcgggccatactacgcggcg

SEQ ID NO: 2610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccacgttgaatcgtaccaacggagtcgg

SEQ ID NO: 2611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccagcattgatgtggcccgtcaatcccg

SEQ ID NO: 2612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccaggaccaaaatcgacttttgcatatc

SEQ ID NO: 2613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccagtctagggtgccgattcgcgatgca

SEQ ID NO: 2614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccagtgccagtgtgcactagggagcccg

SEQ ID NO: 2615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccagtgttgttgcggtgtgaacgggact

SEQ ID NO: 2616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcccacctctcgacgggtgctccgcagat

SEQ ID NO: 2617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcccagtctagagaccgactaaatacgtt

SEQ ID NO: 2618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcccctcttcgtcgtcattatcatcgccc

SEQ ID NO: 2619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccccttgtcagatgaccctttcctggag

SEQ ID NO: 2620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcccggccacgattgccagaccacgaata

SEQ ID NO: 2621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccctaggagatagttccgaatgacagtc

SEQ ID NO: 2622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccctgagagtcgtgataacacgcgtgag

SEQ ID NO: 2623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccctgtggcaacacttgcggcttggtgc

SEQ ID NO: 2624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccgactgcggagctagagaccgcacttc

SEQ ID NO: 2625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccgcacggtgggtgagcgcggagaaatc

SEQ ID NO: 2626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccgcagtgaaagagggcagagacgctag

SEQ ID NO: 2627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcctagggatcgtcgtggcagcgctgggg

SEQ ID NO: 2628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcctagggctcagagtctaactctcgtac

SEQ ID NO: 2629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcctcaaatcttttggcatgtaatctggt

SEQ ID NO: 2630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcctcggataatccagcgtctccttctgg

SEQ ID NO: 2631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcctggattattctgccgctagacatccc

SEQ ID NO: 2632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcctgtaatactcgcgggtggctgcacgc

SEQ ID NO: 2633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccttcgcgttatgcttaccctcgtgata

SEQ ID NO: 2634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccttgtggcgacatgccgaacgccgggt

SEQ ID NO: 2635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagccttgttggaggggacattgtggtttgt

SEQ ID NO: 2636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgacacaagtgagtttggctccccccgg

SEQ ID NO: 2637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgacttactcctcttttgcatttctgat

SEQ ID NO: 2638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgagctcgaccaatgctaacatgagaca

SEQ ID NO: 2639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcacgcctctactagccgtcgttcgtg

SEQ ID NO: 2640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcaggagtgttgtcactagcgaccctt

SEQ ID NO: 2641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcaggtgccactcgtgcgggcggttcg

SEQ ID NO: 2642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcatgggatggtgcggaatcattggtt

SEQ ID NO: 2643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgccacggctacctagttagtaacgggg

SEQ ID NO: 2644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgccaggggacagaacttatgaaggggg

SEQ ID NO: 2645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgccatgcccatctgcatcacggtgagg

SEQ ID NO: 2646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcggattgccgctgtttggctgggttc

SEQ ID NO: 2647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcggtaggcatacacacctagtggcac

SEQ ID NO: 2648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcggttgcgtaatagtctgtatgatgt

SEQ ID NO: 2649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcgtcacggtccattctcctttaaaat

SEQ ID NO: 2650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgctgactgtaggcgaaagtggtacgtg

SEQ ID NO: 2651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgcttactcttggggcttaggcgggtcc

SEQ ID NO: 2652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggaaagcggataaaagtttgcttaccg

SEQ ID NO: 2653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggaggtgtagccctcaccgtgaatcgt

SEQ ID NO: 2654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggagtacgcaaacatggcaagttcgtc

SEQ ID NO: 2655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggcacgtcgggttatgtgagcagctcg

SEQ ID NO: 2656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggcctaccacttagttaactaccggaa

SEQ ID NO: 2657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggcgaggggagcgagttgtacaattca

SEQ ID NO: 2658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggcgatacgttggcccattattaggtc

SEQ ID NO: 2659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgggaactgagtaacggaaggagcggtg

SEQ ID NO: 2660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggggtgacgtaattgcttcagttgtta

SEQ ID NO: 2661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcggtaacgtgcgtgtacgtattcataag

SEQ ID NO: 2662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgtagcggctctacgtccgatctagtgc

SEQ ID NO: 2663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgtatggtggcttcatcagtgcagtcaa

SEQ ID NO: 2664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgtgggactggtttactgtcagtgccgg

SEQ ID NO: 2665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcgttcatgaccacaggtttgggtgtcga

SEQ ID NO: 2666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctcccgggcgcacggttgccggtctcac

SEQ ID NO: 2667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctcctgtggttcgcactcaggccggtcg

SEQ ID NO: 2668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctcgtcctctgccccgtgggtcactccg

SEQ ID NO: 2669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctctacgttttctacgtgttattgcatg

SEQ ID NO: 2670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctctccacggctcatgcttctggatgta

SEQ ID NO: 2671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctgcgcgctgaggcatagaccgcgatgt

SEQ ID NO: 2672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctgcgttgcagacgcgagatcaactatg

SEQ ID NO: 2673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctggaatttcctcttgtagcggtttcac

SEQ ID NO: 2674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctggcactgtgcgtctatttgagattta

SEQ ID NO: 2675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctgggatggttttaaacttcttgggggc

SEQ ID NO: 2676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctgggtggcaagtagctctgagcacctg

SEQ ID NO: 2677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctgtgcagactaccgggtctcgtggact

SEQ ID NO: 2678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcttaatggtcgggggaggtggtatgctg

SEQ ID NO: 2679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcttagtttattacgcgtggcttcgtagt

SEQ ID NO: 2680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcttgagatggtcccgcctggcaggttcg

SEQ ID NO: 2681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcttgaggatcgcagacgacgaatcttcg

SEQ ID NO: 2682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagcttggtcaacttcgtacttactttttat

SEQ ID NO: 2683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagctttgtattagattccaaatctcaccaa

SEQ ID NO: 2684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaaagaagcggccatgggtgcggcggtt

SEQ ID NO: 2685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaagacggatgtgatattctactcctgc

SEQ ID NO: 2686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaagtcactcgtgatatcgtagttatac

SEQ ID NO: 2687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaatccaacctttgtctcgactgcggtg

SEQ ID NO: 2688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaatgctacgtaatacgcggttctccac

SEQ ID NO: 2689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggacactcgatgggcgcatatggtggcgg

SEQ ID NO: 2690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggacctccccggacttagctacgctgcgc

SEQ ID NO: 2691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaccttctgagtagttggttatcgaaag

SEQ ID NO: 2692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggacgctgcaggttattctggaagtcgga

SEQ ID NO: 2693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggactcggtaggattcgttagctgatggg

SEQ ID NO: 2694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggacttgtgcttccggccgtcacagatta

SEQ ID NO: 2695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggagaggacaacgtgaggcggtggtgtca

SEQ ID NO: 2696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggagccgctttcttgtagcgtaagagtca

SEQ ID NO: 2697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggagcggacatcgcagcgcactttctgta

SEQ ID NO: 2698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaggcactctgattggtggttgaaccgc

SEQ ID NO: 2699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggaggtcgcgaaaattagccctgggtctg

SEQ ID NO: 2700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggagtcagcgagagcgagcaacctctgtg

SEQ ID NO: 2701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggagtggtctaaagtggctatccaggctt

SEQ ID NO: 2702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggagtttagagcgtttgacgtaatgccgt

SEQ ID NO: 2703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggatcaagctggtagtcaataccaaagga

SEQ ID NO: 2704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggatccatcgactgcaattcgcgtgatat

SEQ ID NO: 2705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggatggaggtaatcggcatatcccccgcg

SEQ ID NO: 2706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggattaacatgcatcccgtgcattgtaac

SEQ ID NO: 2707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcaatctagctcacaattgttcattagg

SEQ ID NO: 2708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcagacctcctggaggaagccattcggg

SEQ ID NO: 2709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcagatcatccgtcttcccccatgctat

SEQ ID NO: 2710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcagatgggcgcgcttccacgaacctcg

SEQ ID NO: 2711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcaggggtaactcagctttaggtgtgcc

SEQ ID NO: 2712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcaggggtatggtgtcgacgagctaacg

SEQ ID NO: 2713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcaggtgggccgatccacaccctatatg

SEQ ID NO: 2714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggccagtcttgtaagcgccgtgggagttc

SEQ ID NO: 2715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggccccgtcgcttgcatcgcaaatcccac

SEQ ID NO: 2716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggccgatgatggctcctgtgcgttgcgtg

SEQ ID NO: 2717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggccggggggagtaagcgtcgacttggtt

SEQ ID NO: 2718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggccgtcgtcattctgatttaataattgt

SEQ ID NO: 2719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcgacatgaacgagatcaagcaggcaac

SEQ ID NO: 2720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcggcggacaaacaggcgggatctctct

SEQ ID NO: 2721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcggtctcgtacggagctctccaggggt

SEQ ID NO: 2722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggcgtcagtaatcgattctcctctcgtgg

SEQ ID NO: 2723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggctgacggtgggacactaccctctgcgt

SEQ ID NO: 2724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggctgagggattgcgccacgccaggcaag

SEQ ID NO: 2725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggaacaacgccgtcaagcaggctagtct

SEQ ID NO: 2726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggaagctgtatgaggttcgtattcgctc

SEQ ID NO: 2727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggaaggagcacgtagctcgcgagacctt

SEQ ID NO: 2728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggaatcgtcataattggcgtgttgttgc

SEQ ID NO: 2729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggacaccgctcgttagaccagaggcaag

SEQ ID NO: 2730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggacacgtacgcgataagtcaagggtag

SEQ ID NO: 2731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggacaggcgaacgacatgaggcgcaacg

SEQ ID NO: 2732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggacggttcttaacctgcgaggcgtttc

SEQ ID NO: 2733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggagatgtgagaggggggcatttgtgag

SEQ ID NO: 2734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggaggtttggggacctagctgatttggt

SEQ ID NO: 2735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggatccgacgcactctcttgggcctcga

SEQ ID NO: 2736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggccgatggtagggatcgtttgttcagg

SEQ ID NO: 2737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggcgcccgtgctttatcaagatacgcaa

SEQ ID NO: 2738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggcggtcgatcggtagccggatcatacg

SEQ ID NO: 2739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggggaatggagagtcgcatgtggttgtac

SEQ ID NO: 2740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggggatggtggacggtcggtctctacacg

SEQ ID NO: 2741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggggaaaacagtgtggtgggatggaatc

SEQ ID NO: 2742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggggaggacgcagccgggtaacaagccg

SEQ ID NO: 2743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggggggcgaacctctagtgttgcactcta

SEQ ID NO: 2744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggggttaccgtactgcttcctgatcaga

SEQ ID NO: 2745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggtagcgatacgaggtggcgcttccttt

SEQ ID NO: 2746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggtaggctggggtaacggcacaaagtcg

SEQ ID NO: 2747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggtcacagcgcggatccgtcttcgcatg

SEQ ID NO: 2748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggttatcagggacatgttttaacccttc

SEQ ID NO: 2749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggttcgaaactccgaacaaagtattggt

SEQ ID NO: 2750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagggttgcgaggcttttgtccttggggtaa

SEQ ID NO: 2751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtactgctttcctcctttggcgcggacc

SEQ ID NO: 2752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtagttcaacgttatggttaggcgtgtc

SEQ ID NO: 2753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtatgggtgagccacgacgttctggcgt

SEQ ID NO: 2754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtccgaacttgtcttcagacatgtggcg

SEQ ID NO: 2755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtcgcacgcatcctcgcagccactctat

SEQ ID NO: 2756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtcgcgtacgcagaagccgtggcatgca

SEQ ID NO: 2757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtcggactcatcctagaagattcatgta

SEQ ID NO: 2758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtctcgcacgctactgccagctgaactt

SEQ ID NO: 2759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtgattcacggttttcttgtggcatttg

SEQ ID NO: 2760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtgcaatccgtatgaatgtccgggcgcc

SEQ ID NO: 2761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtgcccttgggggatagcgtagtctagc

SEQ ID NO: 2762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtgggaagctaagatgggcggtaaccgg

SEQ ID NO: 2763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtgggcttccccgcagcaatccactatc

SEQ ID NO: 2764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggttaaggccgggaatgtttctcgcaacg

SEQ ID NO: 2765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggttcgcttccgagagacgagtgttcatg

SEQ ID NO: 2766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggttggaactcggcgtgagagaattccta

SEQ ID NO: 2767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggttgtgtagtgggccactcggaaacgca

SEQ ID NO: 2768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggttgttgtacgtgaatttacctgcacgg

SEQ ID NO: 2769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtttaagcaacaatcctggcgggtttgg

SEQ ID NO: 2770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtttaccgacatattggggcggctcccg

SEQ ID NO: 2771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acaggtttcctcaactgtacatctcgatgcca

SEQ ID NO: 2772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtaaaagttcaacttgtagggcgaagtgt

SEQ ID NO: 2773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtaaagagtcgccgggagccattgcacct

SEQ ID NO: 2774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtaacgctagagctatccccgcacctcgg

SEQ ID NO: 2775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtaacgggctgcagcgtatgagacggctg

SEQ ID NO: 2776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtaaggtgtgtagagttcaggctggggcg

SEQ ID NO: 2777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtaatgcccctgtatcgggagcacgtggt

SEQ ID NO: 2778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtacaccttaacgcatgcgacgaccctcg

SEQ ID NO: 2779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtagctggtgtgtaagaggagcaagcgga

SEQ ID NO: 2780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtatttatcggcaactgagcgttcttcaa

SEQ ID NO: 2781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcaaaagcatgaaatctaggaccggggc

SEQ ID NO: 2782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcaagcgactcgtatgtgatcacgcgtc

SEQ ID NO: 2783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcactgccgtggaaagttagtcggactc

SEQ ID NO: 2784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcagagcacacccgcctaaacttagtag

SEQ ID NO: 2785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcagccctgcggaacgaattgcgccgat

SEQ ID NO: 2786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcagggatgccgtaaagagcttttcgtt

SEQ ID NO: 2787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcagtccgtatgctctcctggatgaccc

SEQ ID NO: 2788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtccaagggcgagttcgagattgtcggcg

SEQ ID NO: 2789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtccacgaatgctgtttggttccggtgcc

SEQ ID NO: 2790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtccctcgggattcaatcctcctggcgga

SEQ ID NO: 2791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtccgacgtgctcatatccgggcaagctg

SEQ ID NO: 2792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcctcaccggaagtggctcaagttacgg

SEQ ID NO: 2793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcctcttaagcggcagctaccggcattt

SEQ ID NO: 2794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcgagacgggtcttgctagcagggcggc

SEQ ID NO: 2795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcgcaacgccggcatgctggagcccggg

SEQ ID NO: 2796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcgcaccgggcaaggatctctagtcccg

SEQ ID NO: 2797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcgctgacaaggtcgagacgccgcaatc

SEQ ID NO: 2798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcggcatgcgattcacgggagacaaagc

SEQ ID NO: 2799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtcgtgtgtcacctcggaacgctcattac

SEQ ID NO: 2800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtctaattgagacatccgctctactgaaa

SEQ ID NO: 2801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtctatcgtgccttgttacatacgccgct

SEQ ID NO: 2802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgacgactctgtaaaggtaattcttttg

SEQ ID NO: 2803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgatgtggttaacgccaggaccatggca

SEQ ID NO: 2804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgattctgttatcatctaggctctgcta

SEQ ID NO: 2805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgcggttagtcgtttccttgggaaccca

SEQ ID NO: 2806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgcgtacagagctgttcccactttgcgt

SEQ ID NO: 2807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgctgctgttaggtcgcgcccctctttg

SEQ ID NO: 2808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtggacccgtgctgtcagggaaccaaggg

SEQ ID NO: 2809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtggcaatcagaaggtggaaggtacggaa

SEQ ID NO: 2810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgggaaatcagcttttcgtggagttgcg

SEQ ID NO: 2811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtggggctgagggcgggcagtatttgctc

SEQ ID NO: 2812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgggttaacttaatgcatttcagcaatc

SEQ ID NO: 2813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtggttagttagttctgctgttgccggat

SEQ ID NO: 2814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgtatgtcgatccctttgacatcttatt

SEQ ID NO: 2815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgtcagtgttaggaaagggctcagtacc

SEQ ID NO: 2816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgtcgtggccaaccaatcgcgttgctac

SEQ ID NO: 2817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgtgagccccggagcaacgagtcggatt

SEQ ID NO: 2818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgtgatgcactttcgtgcagagattatg

SEQ ID NO: 2819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgtggaggtcctaccaatatgtgcaaca

SEQ ID NO: 2820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtgtggctctcgtatgagggtcagttgct

SEQ ID NO: 2821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttaatcgcggccttataattcgatcatc

SEQ ID NO: 2822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttagcccgccaaccgcaaagcctaggtg

SEQ ID NO: 2823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttcaaaggtttggataaggctccgtcct

SEQ ID NO: 2824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttcagaacgtagttggagctgctaatgg

SEQ ID NO: 2825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttcagctctggcatgcgtggggtatcgt

SEQ ID NO: 2826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttccatctcgattaggggtagtgactgg

SEQ ID NO: 2827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttgagctcgtccatgtggagccagacca

SEQ ID NO: 2828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttgaggaagcataacatctgtacaccct

SEQ ID NO: 2829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttgtagctcgcgcattgggttcgcactg

SEQ ID NO: 2830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagttgtgttgaggcatcgtgcacaggtttg

SEQ ID NO: 2831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtttaacaactgtgaatctctgtattggg

SEQ ID NO: 2832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtttagcccgatcgggttttctgtgattt

SEQ ID NO: 2833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtttcgtccgtacgttctgtggtagttgc

SEQ ID NO: 2834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtttggggctcttgtgttctccaagtgtc

SEQ ID NO: 2835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtttggtttattgccatacgttctccagc

SEQ ID NO: 2836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acagtttgtgtatgttatcctgcgggattgat

SEQ ID NO: 2837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataacctgtgcggcgttagatgtgtcttgc

SEQ ID NO: 2838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataacgcgacggcgatttggacccgtatcg

SEQ ID NO: 2839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataacttactcagtccgcctcaccaatgga

SEQ ID NO: 2840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataacttctatctcgataggtaggagggtc

SEQ ID NO: 2841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataagcttgacctacgaacgcgtccctagc

SEQ ID NO: 2842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataaggaaaggcaagccgatctgctcgtcg

SEQ ID NO: 2843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataaggtgtgcatctaagacccgcagattc

SEQ ID NO: 2844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacaagcacgccgcgcctgtgtatcgttg

SEQ ID NO: 2845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacacatccattgcagtatctttggtagc

SEQ ID NO: 2846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacagcgggtctccagttcgttatcgagg

SEQ ID NO: 2847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacagtcgatcgccgaagcgtgcggggag

SEQ ID NO: 2848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataccacgatgccgggcccggtattttgct

SEQ ID NO: 2849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataccagtcgcaggccggatggatgaacac

SEQ ID NO: 2850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataccgaccactatttgtgtcccgggtagc

SEQ ID NO: 2851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataccgtgttcccatcgcgcagagtatggg

SEQ ID NO: 2852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacctcacggtgcgggtggccgactgttc

SEQ ID NO: 2853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacctttgtagactcgaacctgttcacta

SEQ ID NO: 2854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacgcaatcctgttctatcggtactgtct

SEQ ID NO: 2855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacgcctttacgaagtgcgaaaagcgtag

SEQ ID NO: 2856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacggacgcattccccctctgcgggtatc

SEQ ID NO: 2857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacgtgggcactgttagtatcggcacgct

SEQ ID NO: 2858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatactacgcttctttgctaccggactttag

SEQ ID NO: 2859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatactatcgcaataagcaactcctaactct

SEQ ID NO: 2860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatactgactctttggtactctggatgcggt

SEQ ID NO: 2861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatactggtcagatgttacaaaaacttgtgg

SEQ ID NO: 2862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatacttaccgaaactctccgcaagtagaac

SEQ ID NO: 2863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagatcatctgtgccatcagcgaatgtgt

SEQ ID NO: 2864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagatgtgtctcggcaagagcgaagggat

SEQ ID NO: 2865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagccaacttcaatattggttcacgaacg

SEQ ID NO: 2866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagccggtttatccccgcaagtcgtttga

SEQ ID NO: 2867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagccgttaaggtgtgagttttcggagtt

SEQ ID NO: 2868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagcgaacctcgtatggctcggtgaacgg

SEQ ID NO: 2869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagcgctaaccaacggtaatgttcggtca

SEQ ID NO: 2870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagctctgtttaagacttatcggggtctc

SEQ ID NO: 2871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataggtaagggcttgatgggtgtttccaga

SEQ ID NO: 2872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acataggtgagcgcaccacgttgataagcgtg

SEQ ID NO: 2873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagtgtacgctttggtctgtcggatggac

SEQ ID NO: 2874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatagttatgtagttcttcgcttagcacggc

SEQ ID NO: 2875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatataatttgatctcttttcactccttgta

SEQ ID NO: 2876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatcaacgacgtatcactatctccagtcg

SEQ ID NO: 2877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatcacgccgcattggccgacactctcta

SEQ ID NO: 2878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatcatggcgcatggcttgcgaacgggtc

SEQ ID NO: 2879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatcatgggatggtggcactttttatggg

SEQ ID NO: 2880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatcggctgaagggagtggccaaaatcta

SEQ ID NO: 2881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatgaggattctggtggtcattcagtggc

SEQ ID NO: 2882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatgcaggacgttgtcggtgcgtacactg

SEQ ID NO: 2883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatgtcacggcttggtgctcacgatcatc

SEQ ID NO: 2884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatatgttaatcataaggtgtttgctatcca

SEQ ID NO: 2885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcaaccggggtgctggcacaggtggcata

SEQ ID NO: 2886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcacagactttacaatgttgctatgtttt

SEQ ID NO: 2887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcacaggtgcgagccagctatcgttgact

SEQ ID NO: 2888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcaccctaatgtttatttgatggtcgcat

SEQ ID NO: 2889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcaccgagatacaccacttcagcggacca

SEQ ID NO: 2890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcaccggggagaagagcgctaggggcaca

SEQ ID NO: 2891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcaccgtttagttggccagcctgacgggg

SEQ ID NO: 2892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcacctggtagtctgcctgcacctccacg

SEQ ID NO: 2893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcacgtagtattttacatttgagtatttt

SEQ ID NO: 2894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcagagccggtggggctgtaccgaccctc

SEQ ID NO: 2895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcagctgcacacagattcctgttcgccga

SEQ ID NO: 2896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcatgaagatttataacctttatgggtac

SEQ ID NO: 2897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcatgcctgtgatcttggacccgtgacaa

SEQ ID NO: 2898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcatgcggggcattcctgttgtctgtggc

SEQ ID NO: 2899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccacaccactacgggctaacgtgttccg

SEQ ID NO: 2900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccacgattcatgggagcgctggtgagga

SEQ ID NO: 2901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccagcggattctgtgtgcaccttgctat

SEQ ID NO: 2902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccatcggcgataggagtgcgtttgcctg

SEQ ID NO: 2903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcccagcatttcgcaagttcccgggagga

SEQ ID NO: 2904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccccgttaatccctgctcgcggatccgc

SEQ ID NO: 2905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcccgaaattagcacgtcgtttcgccgca

SEQ ID NO: 2906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcccgcgaacgaatcacgttgcttgacct

SEQ ID NO: 2907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcccgcgcccaacctcgtcttgggagccg

SEQ ID NO: 2908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcccggttcaccaactacttcggtactgg

SEQ ID NO: 2909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcccgtacttccccagaaggttcattttt

SEQ ID NO: 2910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccgcaccaacatagcgtgtacgcattgt

SEQ ID NO: 2911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccgcgcgtatacgggattcaacgtggaa

SEQ ID NO: 2912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccgcttgttcaggtttgttcccgtcggt

SEQ ID NO: 2913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccggaaggtgcatagggttgcggttgga

SEQ ID NO: 2914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccggcacgcagtcaactgttggaccagt

SEQ ID NO: 2915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccggctgcaacggttccattgactcctc

SEQ ID NO: 2916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccggggcgagtagattcttcggatcttt

SEQ ID NO: 2917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatccgtttaacagtcgagtgcactcgcagt

SEQ ID NO: 2918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcctcgcttaatatcacgagcgacgattt

SEQ ID NO: 2919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcctgcactatttagtccggccagccgtg

SEQ ID NO: 2920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcctggtgcgttgcttcccccttccgggc

SEQ ID NO: 2921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgaaccgcgcaagtaaaagttggtgtat

SEQ ID NO: 2922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgaacgttgcagtattattatgactccg

SEQ ID NO: 2923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgagcgtcgtgcctctcgtttaggttga

SEQ ID NO: 2924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgaggaaattgtcttatgaaatgcgagc

SEQ ID NO: 2925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgaggcgggcactttctcggtgggggcg

SEQ ID NO: 2926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgatttccaccgagcacgagttacaggt

SEQ ID NO: 2927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgccatacgacattgtgactgcggcgcg

SEQ ID NO: 2928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgccttggtatacctaatcctcggaggg

SEQ ID NO: 2929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgctagcggtggggagtgtacggacgtc

SEQ ID NO: 2930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcggcagtggactcaactacgtcgtctgt

SEQ ID NO: 2931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcggctcaacttgcacgacctttatctgc

SEQ ID NO: 2932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcggggactggtcacgcggacaaacaccg

SEQ ID NO: 2933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgggtaaatggcacgttaagcgattaac

SEQ ID NO: 2934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcggtcacctgtcaatgcgagaaacgttt

SEQ ID NO: 2935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcggtccatcacgcgggactagttctagg

SEQ ID NO: 2936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcggttagggttgaccctatagcatgggc

SEQ ID NO: 2937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgtcgcgtcagggatgtgggcacgttac

SEQ ID NO: 2938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgtgggctttgaccatttcgctcgatgt

SEQ ID NO: 2939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgttacgggaccgggacacattttctcg

SEQ ID NO: 2940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcgttgcgatactaggtgggcagcactat

SEQ ID NO: 2941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctcccacatgtcgtctagctattgtgac

SEQ ID NO: 2942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctccggctggaccagcaagggtgtaggc

SEQ ID NO: 2943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctcgaaacttcctattgaaaccgcggtg

SEQ ID NO: 2944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctcgaccgtctagcaagtggtttcccct

SEQ ID NO: 2945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctctaaacttgatcttcatgtcgaccaa

SEQ ID NO: 2946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctgatacttgctacttgttttgaccagc

SEQ ID NO: 2947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctgatatcaacttgtcaagaaagcggcg

SEQ ID NO: 2948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctgccgggccgtctaaatagaagcggtt

SEQ ID NO: 2949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctgcgactatcacggggcatttgtcaaa

SEQ ID NO: 2950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctgtgctgttcagtgcatctcaggctgt

SEQ ID NO: 2951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatcttgcaaatttgtcggatggtctgcggt

SEQ ID NO: 2952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatctttgaaattaaaagtgtatcgctaata

SEQ ID NO: 2953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgaataccatcctaaagtagggacccact

SEQ ID NO: 2954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgactaaacttaaaaacaatgggaaaacg

SEQ ID NO: 2955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgactctcgagtgcacgacgctcactttt

SEQ ID NO: 2956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgagagaggacagtaaactcccacgtctt

SEQ ID NO: 2957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgagaggcagacgttatgaccagtcacaa

SEQ ID NO: 2958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgaggccagctcgcacaagcgggtctggc

SEQ ID NO: 2959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgagggttgcacgcggacagtagacagcc

SEQ ID NO: 2960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgatatatccagccgatacggttcgctgc

SEQ ID NO: 2961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgattgcgcaatgctacgtgtcaaggtgc

SEQ ID NO: 2962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcaatttcggaatttcgagctctgacgt

SEQ ID NO: 2963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcaatttcggttatatgtccctgatttt

SEQ ID NO: 2964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcacatggcgacggtatacacccatgag

SEQ ID NO: 2965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcactgcactgcgcggaataagtgtcaa

SEQ ID NO: 2966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcaggaggtctatctggtccatgagcga

SEQ ID NO: 2967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcagtttggtgtcgccgaagtccggggt

SEQ ID NO: 2968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcatgggaaaggagtggatagagtacct

SEQ ID NO: 2969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgccacggtcttctcgcagaagggtgctg

SEQ ID NO: 2970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgccatacatcgcggatctgtgggtatgg

SEQ ID NO: 2971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgccatgcatgcgcgagtgccacacacgg

SEQ ID NO: 2972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcccgggacggtggcatagggcaagtgg

SEQ ID NO: 2973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgccctgaaccctgtatctagttgtgatc

SEQ ID NO: 2974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgccgctccgtttctcctaccttcgcctc

SEQ ID NO: 2975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcctctgttagcacggcctcaacttcgt

SEQ ID NO: 2976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcctgaataccctccggcagcggctgtg

SEQ ID NO: 2977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcctgtgaggggacgggggtggggcctc

SEQ ID NO: 2978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcgactgttcctagatctgtcagccgtc

SEQ ID NO: 2979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcgagcatagggttgaggcgccagccct

SEQ ID NO: 2980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcgcagaatagcatttttggaatcaccg

SEQ ID NO: 2981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcgcatacatctttccatctcgccgccg

SEQ ID NO: 2982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcgcctcgatttagggacctgttgtctc

SEQ ID NO: 2983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcgcgccgttagagtcgagttaggggcc

SEQ ID NO: 2984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcggacgtatggtatagcaattctaccc

SEQ ID NO: 2985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgcgtgcgagctcgaaagatttcaaacgt

SEQ ID NO: 2986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgctcaattgcgaaatgctctccaaccaa

SEQ ID NO: 2987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgctcagtgtggaatgtgtgtacttgacg

SEQ ID NO: 2988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgctcgatagtagcgggctgggctgctat

SEQ ID NO: 2989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgctgatgattacttgagcagccccgcgt

SEQ ID NO: 2990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggaaccaaaacactgctacgtattgttc

SEQ ID NO: 2991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggacagccacacgccggtacactatgtt

SEQ ID NO: 2992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggacccatttacagatatacatactcgc

SEQ ID NO: 2993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggcaccaataggggaatacatgaaggcg

SEQ ID NO: 2994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggcagtgtggtgagggttggcgtccatt

SEQ ID NO: 2995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggcccacggcgatatcgagctcggtgtg

SEQ ID NO: 2996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggccggtgcgtgtgcagtggaagggggt

SEQ ID NO: 2997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggctcggtttttaagaccgcggcgggcg

SEQ ID NO: 2998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggctgttccaacggacgcggctgccgtg

SEQ ID NO: 2999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgggactcgcgggaacaactagtcaccaa

SEQ ID NO: 3000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgggcgcgggtttcactgacgggctttta

SEQ ID NO: 3001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgggcggcgagacaccagacactggtttc

SEQ ID NO: 3002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgggtcgttcgtggatgcgggggctattg

SEQ ID NO: 3003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggtaagaccggagtttcagtacatcgcg

SEQ ID NO: 3004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggtaattaaaggatggttgcagtggtgg

SEQ ID NO: 3005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggtccgacgatgccgttaactccagtgt

SEQ ID NO: 3006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggtgcccgatgcggcgagtgcgtgtggg

SEQ ID NO: 3007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatggttggaagcccgcactgggtcgcaata

SEQ ID NO: 3008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtaacagtttgtaccccggattctatta

SEQ ID NO: 3009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtaaggagtgtcctcatgccaagccgac

SEQ ID NO: 3010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtacgcatcgaacgctggatggggttaa

SEQ ID NO: 3011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtagaccctacctggtagtacgcctcct

SEQ ID NO: 3012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtaggggtggcctctgatcttactccac

SEQ ID NO: 3013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtatttcggagcactacttacggtgcct

SEQ ID NO: 3014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtcaatccgaacgcgcgctgatgttggt

SEQ ID NO: 3015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtcacccgcggtaggagatcatggatcg

SEQ ID NO: 3016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtcatagagtttggtttgccaccctcat

SEQ ID NO: 3017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtccccgacagctcagaccgactggcac

SEQ ID NO: 3018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtccctctcgcgtgtttagttggactat

SEQ ID NO: 3019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtccgcgcttgttagttaacgaattgtg

SEQ ID NO: 3020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtcgaaccgagtgtcttcgagagtgggc

SEQ ID NO: 3021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtcgacggggggtgagcgcggcagtatc

SEQ ID NO: 3022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtcgcgctttcttcggcctccgtgaacg

SEQ ID NO: 3023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtgcgcgagacgaggcgcgtttcctggt

SEQ ID NO: 3024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtgcggtagcttacggagcccaatcctt

SEQ ID NO: 3025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtggacacttcagcaagttaggcgtcat

SEQ ID NO: 3026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtggtacttgatcaggaccccccgtgca

SEQ ID NO: 3027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgtgtcgatgtctcaccagcacaccacgg

SEQ ID NO: 3028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgttaggggcagtcactttgaaggtgttc

SEQ ID NO: 3029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgttcagctaggtgtaaagtggagtgccc

SEQ ID NO: 3030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatgttggatgccatgcgagcgtctcctgtg

SEQ ID NO: 3031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattaaaccgttcacctataaccaggtaatc

SEQ ID NO: 3032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattaatactcccataccatacgcggaacga

SEQ ID NO: 3033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattacagggacgacgggttgcagcatggat

SEQ ID NO: 3034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattacgctctttcgtgttggtgaggtaatg

SEQ ID NO: 3035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattacttcttccgccgccctgatgcccgtg

SEQ ID NO: 3036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattagcagcatagtatcgcgaggggtttgt

SEQ ID NO: 3037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattagccaggagtggcccgaggtaccgctc

SEQ ID NO: 3038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattagctccctgccacacaaccgctccgtc

SEQ ID NO: 3039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattagctttacagtgtgcctgtacgggctg

SEQ ID NO: 3040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattagtacaggttcgtgatctgcgtaaatc

SEQ ID NO: 3041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattagtataacacttgcgtccagctacaac

SEQ ID NO: 3042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattatacctctgcggtatcgtttgcaatag

SEQ ID NO: 3043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattatatcgccgtgtgactagaagggggct

SEQ ID NO: 3044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattatgcatctataccatgtagtgggtgtc

SEQ ID NO: 3045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcaagcgggtgctgtctggcatggtctg

SEQ ID NO: 3046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcagacgggcgagtgtaggataccgtga

SEQ ID NO: 3047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcaggcggcgattcgtgagaaacggtcg

SEQ ID NO: 3048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcatttcgtgctttaggagtgcttttcg

SEQ ID NO: 3049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattccagctttcctgcccatatgagtaggt

SEQ ID NO: 3050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattccatccagtcaccctatgtccagcttc

SEQ ID NO: 3051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcccggggacgtgttgcccctgtgaacc

SEQ ID NO: 3052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattccctaccgcgtactggccgtcagaaac

SEQ ID NO: 3053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattccctcagacctggtgttgcgtcgcgtc

SEQ ID NO: 3054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattccgccgttgtactttagatccaccttt

SEQ ID NO: 3055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattccgttccgaggtgcagtgggtaggttg

SEQ ID NO: 3056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcgaggactacccgcatcccaaaggttt

SEQ ID NO: 3057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcgcaggcggagtatgaacactactggg

SEQ ID NO: 3058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcgggaatcagcctatgcgttgcacgtc

SEQ ID NO: 3059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcggggggacacagttgctagcactccg

SEQ ID NO: 3060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattcttttggggcgacggcaggctgtcgtt

SEQ ID NO: 3061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgaaccgtgctatgtgttatgcgcttta

SEQ ID NO: 3062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgacatttttgattagcggtggatttaa

SEQ ID NO: 3063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgattatgcggaatttgatcttactcat

SEQ ID NO: 3064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgattggtcacgtgttcttacccggttt

SEQ ID NO: 3065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgcaaggataatagtgattaccgcggag

SEQ ID NO: 3066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgcaccatcgtccctgacccaacgagca

SEQ ID NO: 3067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgcagcgattcagctatttctggcttgt

SEQ ID NO: 3068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgccagccgcgcgccatgggattcacat

SEQ ID NO: 3069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgcctcggcagcgtatagaccgattcct

SEQ ID NO: 3070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgcgcgtcgacggccgtttaaatcagct

SEQ ID NO: 3071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgcttcagcgcacggtactacacaacgg

SEQ ID NO: 3072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattggggacagatccgctttagattgccgg

SEQ ID NO: 3073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgggtgtacattcgcctctttagctgct

SEQ ID NO: 3074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattggtaggttgttcgacctaggaatggtg

SEQ ID NO: 3075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattggtagtgtacgggcccttattggtttg

SEQ ID NO: 3076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgtcgcggcgagctgacgtagctttggt

SEQ ID NO: 3077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgtcggtgtcgctaacatttaccaccgt

SEQ ID NO: 3078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgttcacggagggattattccagggctc

SEQ ID NO: 3079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgttggcagataatatctctcggtatct

SEQ ID NO: 3080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgtttacggcttctttcccgttccggcg

SEQ ID NO: 3081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattgttttatacttatacgatgtggtgatt

SEQ ID NO: 3082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttaaagaggaagtgggtttccatcccca

SEQ ID NO: 3083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttacagagcgcctcgctgattgcgtatg

SEQ ID NO: 3084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttacatcgattcctagaagggtcactcc

SEQ ID NO: 3085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttaccctagagccttcaatgggcactca

SEQ ID NO: 3086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttacgcgactgcggcaagtcccgacata

SEQ ID NO: 3087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttcgatccgtctcaaagcgtctactaat

SEQ ID NO: 3088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttcggccgagtggacattcgcgaatctc

SEQ ID NO: 3089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttctcggactctgtgtagtgatcctcgc

SEQ ID NO: 3090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttgcacatccttcgagcacggaccgcct

SEQ ID NO: 3091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttggtttgtatgttgcgatagcctttcg

SEQ ID NO: 3092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttgtaatcccaagggcttttctctaatc

SEQ ID NO: 3093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttgtagtaggtggttagggcttcaattg

SEQ ID NO: 3094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acattttggtgtgcaattggtgatagtcgttg

SEQ ID NO: 3095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acatttttcggtcaacagtgcgttccatggca

SEQ ID NO: 3096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaaacgcgtactcacacttttcaagctcc

SEQ ID NO: 3097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaaaggacgtagacagtatggtagcgccc

SEQ ID NO: 3098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaaccccggtacgctgcagactcagagtc

SEQ ID NO: 3099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaacttcactaggttttgccagatcagtc

SEQ ID NO: 3100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaagagggatgaaccgattacagatcgta

SEQ ID NO: 3101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaagcacggcggtattcacccgagttggt

SEQ ID NO: 3102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaaggagagagtagtacgatggctgctac

SEQ ID NO: 3103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaattaggcgtattttcctgtccggtctt

SEQ ID NO: 3104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacaaggggattcaaattgggcggtgctc

SEQ ID NO: 3105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacacgacaaactgcatcgccatcgggcc

SEQ ID NO: 3106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacacgcacacctgcacctacgaccgtct

SEQ ID NO: 3107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacagacttcacggaatgctcgtgtcacg

SEQ ID NO: 3108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacaggtggagccgtgtggattggttctc

SEQ ID NO: 3109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacataacgttgactgcactgattctggc

SEQ ID NO: 3110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaccatcaactgtagcggtctggaatctg

SEQ ID NO: 3111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaccgtgcacaccaggatttagccttggt

SEQ ID NO: 3112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacgaactgcccaaaaggcaaggttatcg

SEQ ID NO: 3113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacgcagcatttcggagagcttacaatcg

SEQ ID NO: 3114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacggcggggcttagcaaccagggcttac

SEQ ID NO: 3115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacgtgctcacgccagacaaattcgtcca

SEQ ID NO: 3116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaacgttccagtgaatctaggatccggacg

SEQ ID NO: 3117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaactacttcgagggtccgcctagctgtcc

SEQ ID NO: 3118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagaaaataccggcgttgtaacattatac

SEQ ID NO: 3119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagaataagtggcgtttcgttcacatcat

SEQ ID NO: 3120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagatgtgttacattcccgcaggtttctc

SEQ ID NO: 3121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagccgcggctagtcgacagccgtagtga

SEQ ID NO: 3122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagcgaggggggacgctttccacgtcttc

SEQ ID NO: 3123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagcgcgaggccatagtcttgctctagcc

SEQ ID NO: 3124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagcggagagagtcacgtctatccgatca

SEQ ID NO: 3125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagcggatgcggaagcgtaattatttggt

SEQ ID NO: 3126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagctagtgagaccgaggtgtttttgtgg

SEQ ID NO: 3127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaggagaaggcacggtcggaggtgacaca

SEQ ID NO: 3128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaggcaccgtaacctatattggtcggtta

SEQ ID NO: 3129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaggcgtttcgaccctctgcaccaccacc

SEQ ID NO: 3130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagggcaactttggtatctgtgttctacg

SEQ ID NO: 3131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaaggggttacttcgtgggggctttgtgac

SEQ ID NO: 3132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagtaatcaaccgttacaagatcgagctc

SEQ ID NO: 3133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagtaatggtgcggtcccttgctttctaa

SEQ ID NO: 3134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagtcagttagtttcacggaagtttcgcc

SEQ ID NO: 3135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagtcctcgcgtgtgcctgcatcaggtgg

SEQ ID NO: 3136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagtcgtacatataatcgcggtcttcaac

SEQ ID NO: 3137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaagtctcattagtgagagtggagggatca

SEQ ID NO: 3138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatacggcgcttacttgctaggtctgggg

SEQ ID NO: 3139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaataggacgattcgcgttacaccacggtt

SEQ ID NO: 3140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatcaccgggcgtctcatatcggcgctat

SEQ ID NO: 3141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatccgctggtggatcaagcccccgcgct

SEQ ID NO: 3142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatcctgctctcggcaagctgaccgcgtg

SEQ ID NO: 3143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatcgattcttatcaccggccccgtgttc

SEQ ID NO: 3144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatcttaatgcggcgtgctggtattactg

SEQ ID NO: 3145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatctttagacttgacggttgcggtttgc

SEQ ID NO: 3146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatgaacagggctgtctcatgctgccaac

SEQ ID NO: 3147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatgcagctgctgtttttttcggatgcgc

SEQ ID NO: 3148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatgggcgactcttatcgtttatgtgtgt

SEQ ID NO: 3149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatggggaggcctggacaacgcgtcgcgg

SEQ ID NO: 3150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatgttcggcagggctcaacttctaagtg

SEQ ID NO: 3151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaatgttgtgcattttattgtaattactcg

SEQ ID NO: 3152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaattcattcaatgcggtgtatggacacgg

SEQ ID NO: 3153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaattggtcggcgttcctaacgagctcgta

SEQ ID NO: 3154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacaaaatcggagccaactccatgtcacct

SEQ ID NO: 3155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacaaactttaatgctactaggtgcgtata

SEQ ID NO: 3156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacacaatcagagttctataatgcgatgga

SEQ ID NO: 3157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacaccaggccccgcggatgctgactgctg

SEQ ID NO: 3158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacacgtcttttccgaatgacatcctgtgg

SEQ ID NO: 3159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacagacatttacacatggctcgggaattt

SEQ ID NO: 3160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacagaccgttgtgcctacattcggaggct

SEQ ID NO: 3161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacagagtattagggctgagggatgctgcg

SEQ ID NO: 3162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacagctgcacggagttactcgttctcgcg

SEQ ID NO: 3163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacaggatgcggcatgcgtctctttgcgcg

SEQ ID NO: 3164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacagggaccagagcattactagcggcgcc

SEQ ID NO: 3165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacaggtaagcggactttatagcttttatc

SEQ ID NO: 3166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacaggtgatgggtattaattcaccagttt

SEQ ID NO: 3167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacagtccttgattactccggcgcttgaaa

SEQ ID NO: 3168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacagtcgccggcttatgttatcaggttga

SEQ ID NO: 3169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatacgaactgggcagttatcttataag

SEQ ID NO: 3170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatcagacatcgatcggccggccggtga

SEQ ID NO: 3171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatcagtgtttaatcgtgtccaatcggg

SEQ ID NO: 3172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatcgacatcgctagtcacgcgcccacg

SEQ ID NO: 3173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatgcccggtgtcggcctttcatcagcg

SEQ ID NO: 3174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatggagccttaccgacctccagtctta

SEQ ID NO: 3175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatggggatgcggcgggcgattgcggtg

SEQ ID NO: 3176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatggtgaccatcggctcacgtgaggac

SEQ ID NO: 3177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatgtacgtcattctctgtcaagttatt

SEQ ID NO: 3178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacattccctcggttacgcccacattttgc

SEQ ID NO: 3179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacattgattggcagccttgactaccggtt

SEQ ID NO: 3180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacatttgttgtcccgatatacgagtacgt

SEQ ID NO: 3181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccaacggtacctgtgctggagcacgttc

SEQ ID NO: 3182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccaccgatttgaatacccgggccggcat

SEQ ID NO: 3183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccacgagaccgctcatctgccgtttggt

SEQ ID NO: 3184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccactcgactcgcatgtcccaagcgact

SEQ ID NO: 3185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccactcgagagcttctttctggctccat

SEQ ID NO: 3186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccacttgttagggcacagagggcatggg

SEQ ID NO: 3187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccagtttctacgatgcagcccgagtgcg

SEQ ID NO: 3188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacccagggtcaaatcggacggttgagcgt

SEQ ID NO: 3189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccccgggcggagtctaacgttttctcgt

SEQ ID NO: 3190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacccgcactaccttaggggccggcgcctc

SEQ ID NO: 3191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccctgcggctacgagaacacttggcgtc

SEQ ID NO: 3192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgatccacgtaggaggttctgggcatg

SEQ ID NO: 3193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgatgcgctcttgaacccgtacacctc

SEQ ID NO: 3194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgatgcgtcgctctccatcaggagccc

SEQ ID NO: 3195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgattgttcgtggtctatcccatccta

SEQ ID NO: 3196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgcactgtgaatgcactcagtcatgtt

SEQ ID NO: 3197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgcgccgtagaacgttccccggccggg

SEQ ID NO: 3198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccggacccggccctgtgttcccaggttg

SEQ ID NO: 3199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgggttgatacataggcccgccacact

SEQ ID NO: 3200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccggtactacgatttcaggccgtatgca

SEQ ID NO: 3201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaccgtgacattacggaagggagaccgttg

SEQ ID NO: 3202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacctaccagccaaaggacaagggctcgcg

SEQ ID NO: 3203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacctaggctatgatcgcgtctggcacctc

SEQ ID NO: 3204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacctgccagggtcttccctgcctacactc

SEQ ID NO: 3205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgaattatgccttgacataggattacac

SEQ ID NO: 3206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgacagctggcctacgccttacgtatgc

SEQ ID NO: 3207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgattggctcgagcttggtaattcttgg

SEQ ID NO: 3208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgcacacgaactccgtttggacaagtac

SEQ ID NO: 3209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgcagagtcacgttcgtgaaaacgattg

SEQ ID NO: 3210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgcatgcatagggcttactgaatgtcgc

SEQ ID NO: 3211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgccaggagcaactattggagccgtaac

SEQ ID NO: 3212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgccatgccggttaattgaggcttcccg

SEQ ID NO: 3213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgcccgggtagtatttcggaaatggcat

SEQ ID NO: 3214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgcctcaaacctaggcacatgtcacggc

SEQ ID NO: 3215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgcctctatgctagaagataacgtccgg

SEQ ID NO: 3216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgctgcacccgcccgaacaggatatgtg

SEQ ID NO: 3217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgctgcttttttgacgctcatgttcaat

SEQ ID NO: 3218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacggaactgctaagcaattcggcaccttg

SEQ ID NO: 3219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacggagcacctcacagttgtcttggccga

SEQ ID NO: 3220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacggcatattgcttctgtgtaggcagatg

SEQ ID NO: 3221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacggcgcgccctaggagaagaacacgcgg

SEQ ID NO: 3222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacggctgttgctgttaataaaagcctcaa

SEQ ID NO: 3223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacggtcgattgggtggcttgctaacgttt

SEQ ID NO: 3224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacggttttggtgctccatgatgatgcgat

SEQ ID NO: 3225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgtattaccctactaaagttggccgagg

SEQ ID NO: 3226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacgtttacgactagaattcttcgctacta

SEQ ID NO: 3227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accactaacagcgaggtggcgacttaccttct

SEQ ID NO: 3228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accactaggggtttgttgctctactgtctcgg

SEQ ID NO: 3229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accactcacttcgtcgctcggttgccgttgca

SEQ ID NO: 3230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accactccctctcaactcaggcggcttgcggc

SEQ ID NO: 3231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accactcgatcccgggccttcggcaggcttgg

SEQ ID NO: 3232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accactggagcataatcgttcgtgctcttcca

SEQ ID NO: 3233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accactggatacccgaccgcggcaatgagtgc

SEQ ID NO: 3234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacttcgttgagtgcatgacactccctgcg

SEQ ID NO: 3235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacttgaacactatcatggcctacaagctc

SEQ ID NO: 3236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacttgagtggtgccattcggtagtaagtt

SEQ ID NO: 3237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accacttgcccgaatgggacgttctattccgt

SEQ ID NO: 3238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagaagaaacatcgacctggcacactgtca

SEQ ID NO: 3239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagaagagggcgggggtatgttccgcacgg

SEQ ID NO: 3240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagaattgtatcattaatttttggggtggc

SEQ ID NO: 3241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagaccacaagttcccgtgttgacgtgtta

SEQ ID NO: 3242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagacggtgggcagacggtgggtgcatgta

SEQ ID NO: 3243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagacttttcacccacctgtgacccgcatc

SEQ ID NO: 3244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagagaaacttgcagctcactccctagatt

SEQ ID NO: 3245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagagaatagggaagctgaacgccgcgcta

SEQ ID NO: 3246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagagattgatctccttacgtgcatgagag

SEQ ID NO: 3247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagagcctttacgctccgcgataattgccc

SEQ ID NO: 3248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagaggcccgctcgcgacgagtgctcctgc

SEQ ID NO: 3249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagagttgagtttggcgctccgacgtttac

SEQ ID NO: 3250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcacacacgtggtgaacgcatggttggc

SEQ ID NO: 3251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcagcagtattgtagggccatgtgtggt

SEQ ID NO: 3252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcaggagtcctgcgtttacgatcagcta

SEQ ID NO: 3253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcatggccccggccggcatcccatgtca

SEQ ID NO: 3254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagccaaccttggtcttggcagaccgctaa

SEQ ID NO: 3255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagccaaggacgaaaacgccatacataaag

SEQ ID NO: 3256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagccaatttaactctcctctcactgcgag

SEQ ID NO: 3257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagccatctggtcaaagcttactttcgtac

SEQ ID NO: 3258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcccaatgagattagagaggacgccggc

SEQ ID NO: 3259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagccgcaggtcaggtgcccgacaactgtg

SEQ ID NO: 3260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagccgttgaccttggactattgaacaggc

SEQ ID NO: 3261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcgcactcacgtcttaactggtttgagg

SEQ ID NO: 3262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcgcttcaattctcttcgatgcaactac

SEQ ID NO: 3263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcggaatcgaggatcgggattagttgtt

SEQ ID NO: 3264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcgggtaaggcggggttggccttcggag

SEQ ID NO: 3265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcggtcgttagaagctgctagccagact

SEQ ID NO: 3266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcgtgtgggacttcgcatgttatcgcaa

SEQ ID NO: 3267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcgttagtgggccagttgattcgaatta

SEQ ID NO: 3268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagcgttttataggctcttccgtggggttt

SEQ ID NO: 3269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagctccagtcaggaatcgagctttgaacg

SEQ ID NO: 3270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagctccccctgttcgggttggtcgggaca

SEQ ID NO: 3271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagctcccggaaaacatcgctgaaaaacac

SEQ ID NO: 3272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagctgagtgcattaaccgcaagacctcgc

SEQ ID NO: 3273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagctgcgggatacttaccatttggctgtc

SEQ ID NO: 3274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagctggggagtgtggcacgggtctgtcgc

SEQ ID NO: 3275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggagcgtctcgatgtacttgacggcgtc

SEQ ID NO: 3276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggatggctcggtcacgtcctcgttgccg

SEQ ID NO: 3277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggccgtatcctaggaagattatttgtgc

SEQ ID NO: 3278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggcgtaccctcccgcgagtgccgtcagt

SEQ ID NO: 3279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggcgtactcatgcgataccctagggact

SEQ ID NO: 3280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggcttacataaccgtcgtcgataagtcg

SEQ ID NO: 3281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagggacatggaggatttgtggcgcggtcg

SEQ ID NO: 3282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagggcacgatagaccaatctagaaggtcg

SEQ ID NO: 3283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagggccataacagcgagcgcgtctgctag

SEQ ID NO: 3284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagggcgtcgcatgaagtcgagtactgcgg

SEQ ID NO: 3285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggtccgcactggtctggatcggcgctcg

SEQ ID NO: 3286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggtcgcgcaagggcgttggttttcctta

SEQ ID NO: 3287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggtgatgggcggggaagtggtgtaatgg

SEQ ID NO: 3288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accaggtgttggcacacgcgccacgatccgat

SEQ ID NO: 3289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtaataacatacctggtaacgatttctt

SEQ ID NO: 3290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtacacccacctgacgacggcccacggg

SEQ ID NO: 3291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtagagatcagggggcgtttcccatctg

SEQ ID NO: 3292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtatcaccgaccgggaagttagctggac

SEQ ID NO: 3293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtatgcatgagcatagcagctgtgcagg

SEQ ID NO: 3294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtcaccgtaaagcccggggttgcgcgtg

SEQ ID NO: 3295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtcactcagagctgtggtctacgattgt

SEQ ID NO: 3296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtcatgtgggatgtgcaatcggaaaatg

SEQ ID NO: 3297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtcccgcgcacgtcgagtcgtcccaagg

SEQ ID NO: 3298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtccgcgcactgatgtgtagcccgatgg

SEQ ID NO: 3299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtggcccgcgtggcttgtttggggtctg

SEQ ID NO: 3300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagttcattgtgctcatcatggccctttgg

SEQ ID NO: 3301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagttgagatcgcactcgatgattacgttc

SEQ ID NO: 3302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accagtttcggaacatactcttgtcatgccgc

SEQ ID NO: 3303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accataacggtcactcgaactcaactattgct

SEQ ID NO: 3304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accataagccagaagtggttaagcgtaggccg

SEQ ID NO: 3305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accataatgtactttgagccattgcgctgtgg

SEQ ID NO: 3306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accataattgcccccgttcaattctaccatcc

SEQ ID NO: 3307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatacattaatagggttcgacatacttgtt

SEQ ID NO: 3308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatacgggatacccttgatgatctagcgtt

SEQ ID NO: 3309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatagattcccctaaatttacggggccatt

SEQ ID NO: 3310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatagccggtatgtcacccgtgtatcggtc

SEQ ID NO: 3311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatagcgactgtggccattttgaacgccgg

SEQ ID NO: 3312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accataggcggagggtcaggcattacgtacat

SEQ ID NO: 3313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accataggctaatgcaaagtgcgattgcacgt

SEQ ID NO: 3314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatagggcatgcagtcgatgcgtgggtgtg

SEQ ID NO: 3315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatagggtctactttaagggcgtgcgggag

SEQ ID NO: 3316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatagtatctgatccccgcatgataggaat

SEQ ID NO: 3317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatatagtttgtgttgacctcggttcgtcc

SEQ ID NO: 3318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatatcgggcgggtctgaacaccaggctgg

SEQ ID NO: 3319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcaagctttgacgtgctggattctatac

SEQ ID NO: 3320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcacgggctcagcagtggtaccggattg

SEQ ID NO: 3321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcacgtgggacagtgtgccgatcggtca

SEQ ID NO: 3322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcactcggccagggctcctgcggttgtc

SEQ ID NO: 3323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcccaccccctggtatcctggcgtggcc

SEQ ID NO: 3324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatccccgcacccttgctaatcggcttttt

SEQ ID NO: 3325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatccggatcaacagcgtaagcccgcgcac

SEQ ID NO: 3326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcctgcagcggtcggctccggtcttgat

SEQ ID NO: 3327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcgaaatgggcgcgtaataaacggcgat

SEQ ID NO: 3328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcgaccgggcgggcaagtttgctttacc

SEQ ID NO: 3329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcggatcgaggcggcccttagctgatcg

SEQ ID NO: 3330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcgtctagcatatgtaccttgcaccgag

SEQ ID NO: 3331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatctcacgctcggttgactgaaacggcgc

SEQ ID NO: 3332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatctctatctttagaggttacgtgtttcg

SEQ ID NO: 3333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatcttgtgcggtacacctgctctctcttg

SEQ ID NO: 3334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgaaaggctccctcgctcggtggccgac

SEQ ID NO: 3335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgaatgaagggctggcgccaacagtgtg

SEQ ID NO: 3336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgacaaggattcgccgacgagaagaggc

SEQ ID NO: 3337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgacccgtttgaatgattaccgcgatcg

SEQ ID NO: 3338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgacggactcgctttcctttgcctttga

SEQ ID NO: 3339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgactttcgtgttctcatatccggtctt

SEQ ID NO: 3340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgagacggttccagaattggaggtggga

SEQ ID NO: 3341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgagtacgagcccctcatagaagtcacg

SEQ ID NO: 3342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgatctcccgagggaaggccgggtttcg

SEQ ID NO: 3343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgatgttggcgtgggttcacactcccgg

SEQ ID NO: 3344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgcatttcatgattgttctgcggtctcg

SEQ ID NO: 3345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgccaggacctacttatttcattcctta

SEQ ID NO: 3346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgcgcggcgcttacacgactggcctctc

SEQ ID NO: 3347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatggagcggcttacatgactaacttagtc

SEQ ID NO: 3348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatggcccgctttacgttcgggtatcgtcg

SEQ ID NO: 3349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatggctgggggcgtccaatgcataggtgc

SEQ ID NO: 3350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgggatccacttcgatatctttggcgtt

SEQ ID NO: 3351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgggcataaacagaagagcggaggcagg

SEQ ID NO: 3352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgggcgacggttcagagaacgttgctaa

SEQ ID NO: 3353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatggggtgcggcgatgcgtgatcgttagt

SEQ ID NO: 3354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgggtcttagtgaccattaaggtcggcc

SEQ ID NO: 3355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatggtactcatggataaggggaagactgg

SEQ ID NO: 3356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatggtcagcgtacttggctggttggacgt

SEQ ID NO: 3357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgtacaagccggtaaagtcggaacttgc

SEQ ID NO: 3358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgtagattttgttgttctcggatgtacc

SEQ ID NO: 3359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgtatgcctaccaccaatatggatgtta

SEQ ID NO: 3360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgtctactcggggcaatgacacgtagaa

SEQ ID NO: 3361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatgttcaccctgcaccaggaggctcttgt

SEQ ID NO: 3362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattaattcagctgtaggattccgtaggtg

SEQ ID NO: 3363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattacgacttgttgacttgcggctaattc

SEQ ID NO: 3364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattaggaggggtgacaacgagttggggga

SEQ ID NO: 3365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattagtgtcgctagagtccggtggcctgt

SEQ ID NO: 3366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattataatcggcgtggaaccctaggcttt

SEQ ID NO: 3367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattccgaaaatgctctggttcgggtattt

SEQ ID NO: 3368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattgactctgtaccgacgactcaggccta

SEQ ID NO: 3369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattgactggcctcaaggagtcgaggaggg

SEQ ID NO: 3370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accattgtaggcgcgttacgggttctgggtct

SEQ ID NO: 3371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttactacccttatgagctgcaacccgt

SEQ ID NO: 3372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttcacgacatctaaggcgcactgcact

SEQ ID NO: 3373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttccgctcacacctaactgtgtttgtt

SEQ ID NO: 3374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttcgcttacgatatcaggcgtttaacg

SEQ ID NO: 3375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttcggaaggtcgagcgcctaaagttgc

SEQ ID NO: 3376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttcgtggaccaacgtgtcatgcaatag

SEQ ID NO: 3377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttctccggtaatattgttcgtcggtac

SEQ ID NO: 3378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttggcaccagcaggactcaattggaac

SEQ ID NO: 3379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttggcatacaacagggtgggctaccgg

SEQ ID NO: 3380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttggcattccatactcgttagcgctcc

SEQ ID NO: 3381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accatttgtgcctgactcgtactttgtaattc

SEQ ID NO: 3382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaacgcactaccgctctgcctagaggcgg

SEQ ID NO: 3383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaacggcaaacaggactatgttggttctc

SEQ ID NO: 3384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaacgggattctagcccactagcgcggtt

SEQ ID NO: 3385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaactcattcattaagtatttcccgtcga

SEQ ID NO: 3386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaactgtcagtacgaatctgtgtttggct

SEQ ID NO: 3387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaagcctttatggtgcgccccgcttgtgt

SEQ ID NO: 3388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaagtgtcatttgctagtaaacctacgcg

SEQ ID NO: 3389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaataccaccgccattcagttaggcaagc

SEQ ID NO: 3390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaatcgtgatcgaatggtcaaccctttgg

SEQ ID NO: 3391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacaaacgagcgggttactagccttgggt

SEQ ID NO: 3392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacacaaaggcactgagaggttcaccggg

SEQ ID NO: 3393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacacaagtgaaaacccctcttatttaat

SEQ ID NO: 3394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacagaatcatttagctggcctggcaacg

SEQ ID NO: 3395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacagcaagccgcggaacgaaggtatggg

SEQ ID NO: 3396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaccagcggtacacgcattaagatgttgt

SEQ ID NO: 3397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacctggaaggccgccatcgtgtggtgtt

SEQ ID NO: 3398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacgagcagggtgagacgtgcgctctgcc

SEQ ID NO: 3399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacgccctttacgctgagtggtttagttc

SEQ ID NO: 3400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacgctaggcttctgagtggtgttttcgg

SEQ ID NO: 3401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacgtcttgtaacattggttagacgatcc

SEQ ID NO: 3402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccacgtgactcgaaatacgaacgcgcaagt

SEQ ID NO: 3403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccactcagctttggagaggggaatgtgtgc

SEQ ID NO: 3404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccactcgtgtgctccagagcgtgcaccgcg

SEQ ID NO: 3405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccactgggcacgctctgccgctcttcggtc

SEQ ID NO: 3406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccagatattctcgttatccagcttggcaca

SEQ ID NO: 3407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccagccactgatcgtctcccgcttaccttg

SEQ ID NO: 3408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccagcggactcgccgacgcatgcgtgttag

SEQ ID NO: 3409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccagctgcactatcctgtctttcgagctcc

SEQ ID NO: 3410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaggcaagcggttggatccctcaccagca

SEQ ID NO: 3411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccagggacgcttagggctagcgtcttggct

SEQ ID NO: 3412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccaggttgttgtgcgtcatacgttttagct

SEQ ID NO: 3413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccagttgttattgcggttttctacccttgt

SEQ ID NO: 3414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatagcgggctgcgcatccccaatccaca

SEQ ID NO: 3415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatcaggactcgcctgccatcccacggcg

SEQ ID NO: 3416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatcagggggtagcgctcatggtgacttt

SEQ ID NO: 3417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatccgtactagcttcgattcggttgtgg

SEQ ID NO: 3418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatctttctgccttgagtggtataaggac

SEQ ID NO: 3419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatgaatacggagtcttatacactggtga

SEQ ID NO: 3420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatgacatattccgagtcaaaacttaggt

SEQ ID NO: 3421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatgagtttgggactgcaagttacggccc

SEQ ID NO: 3422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatgcaccaagtcgttcggcatgccgcat

SEQ ID NO: 3423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatggcgattacaagctttagccacgagg

SEQ ID NO: 3424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatgtgtatccgtgtctgtggtgttgttt

SEQ ID NO: 3425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatgttccgggttaattctccggccgtca

SEQ ID NO: 3426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccattaagtcgtttttaccgcgtgaaggtt

SEQ ID NO: 3427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccattagcggacaccacggtatcggttggt

SEQ ID NO: 3428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccattgctagcgatgcaaatcaggcatctg

SEQ ID NO: 3429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccatttctacgcgccaggggtattacagtt

SEQ ID NO: 3430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccaacgctatgcaccacgcacgtagcaat

SEQ ID NO: 3431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccaataggagctctccgatttaatgtttt

SEQ ID NO: 3432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccacaaatttgtgcgcgggaagacactct

SEQ ID NO: 3433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccacaggtacctctttagggttcgaccac

SEQ ID NO: 3434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccaccccgttcgcgtgaagactggcggcg

SEQ ID NO: 3435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccacgacgtaccaaagttggctactgtgt

SEQ ID NO: 3436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccacgagtatgaggaccaccgcggaacat

SEQ ID NO: 3437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccacgatgagccgccgtccgcttatcatg

SEQ ID NO: 3438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccacgctcaacattcggctcaattccgta

SEQ ID NO: 3439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccacgtggcggagtcggggggctaacccc

SEQ ID NO: 3440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccagcccttcggaacgtcctaccgtataa

SEQ ID NO: 3441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccagctgacaaaattgaaccgtttcccca

SEQ ID NO: 3442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccatcctcccgcttcgagttcgggctgtc

SEQ ID NO: 3443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccatcttaagtcgagatgcctataccggc

SEQ ID NO: 3444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccatgacgatgtaacaggctaccgttatc

SEQ ID NO: 3445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccccatggtgacgcccgtgtacggaagggt

SEQ ID NO: 3446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccccaagtataatgaattcgaggttcgac

SEQ ID NO: 3447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccccctccccgccggatgtaagcaaccaag

SEQ ID NO: 3448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccccggtcgctcccgttcggtgcacagcct

SEQ ID NO: 3449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccccggtgttgtacggtccaacactcagct

SEQ ID NO: 3450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccccgtgttttggaatccgactggtactcg

SEQ ID NO: 3451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccccgttctttggttctcaagaatccgcct

SEQ ID NO: 3452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccctacacggatcttgtgacggtcggctt

SEQ ID NO: 3453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccctcatccgattgatgaaggccgcgtgt

SEQ ID NO: 3454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccctcggatttacacccggcccacgctat

SEQ ID NO: 3455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccctcgtcttttgtcttgtcggtacagcg

SEQ ID NO: 3456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccccttgatacctatgtgactgaaaccttt

SEQ ID NO: 3457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgactaggtactagccagccactccatt

SEQ ID NO: 3458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgagatgctgttctccgaatattggcta

SEQ ID NO: 3459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgcatcaccgctccacgctagaacgtac

SEQ ID NO: 3460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgccagtcaagagtctttcggccgtagt

SEQ ID NO: 3461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgcccctcgcgaccgccggaagatctgc

SEQ ID NO: 3462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgccggtttacattgagctgaaccagtg

SEQ ID NO: 3463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgctgtggtactgaatcatgcccatgtt

SEQ ID NO: 3464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgcttatgtttaggcttctgatgtcacg

SEQ ID NO: 3465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgcttgataggccccttcgtcggttcat

SEQ ID NO: 3466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgcttgtgcacatgagcatgttcgtgtg

SEQ ID NO: 3467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccggagtctgttacccgcttacgacagga

SEQ ID NO: 3468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccggcacctgcatttcggggaatggcaac

SEQ ID NO: 3469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgggtgcgacgtcttaggactgtcgttc

SEQ ID NO: 3470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccggtttggtatagggctcacattcatct

SEQ ID NO: 3471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgtacccagaagtcaacgtactgtttgg

SEQ ID NO: 3472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgtagagatggctggtcctcgagtagct

SEQ ID NO: 3473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgtatgtgactcgataacctgcgctgta

SEQ ID NO: 3474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccgttaagtagaggacgagctcccacgcg

SEQ ID NO: 3475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctacaggttcaatataaggacaaggtca

SEQ ID NO: 3476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctcagagttagcgtcgatctgcagggta

SEQ ID NO: 3477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctcagcgtcgtcggctaagatacggcgg

SEQ ID NO: 3478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctcagtggcaccatgcgctccgtgtcgt

SEQ ID NO: 3479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctcgaacgcttcttttcccaaattgctg

SEQ ID NO: 3480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctcggatacgcaacacgaagatcgattt

SEQ ID NO: 3481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctcggcccaggtttgctaatctcagcgg

SEQ ID NO: 3482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctcttcagggcggggctgtgcactagtc

SEQ ID NO: 3483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctggagactctaaggagcgacccgagct

SEQ ID NO: 3484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctgtctcaacggatccggcctcattgtc

SEQ ID NO: 3485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccctgttacgtcgacgcgtccggacttggg

SEQ ID NO: 3486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accccttgagagccatcactgtctgactctgc

SEQ ID NO: 3487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgaaagccagtcggcgactatgagtagca

SEQ ID NO: 3488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgaacctcgctaaattggcatactctacg

SEQ ID NO: 3489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgaacgagcccgccaactgctcgacgttc

SEQ ID NO: 3490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgaacgtcgcctttcactgtgtttgcaac

SEQ ID NO: 3491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgacaaactgtctaattctgttccgagcc

SEQ ID NO: 3492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgacaacaacggaatcaagtgcggaactc

SEQ ID NO: 3493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgacaaggaggtatgtttgcctaaagtag

SEQ ID NO: 3494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgacacttcgatggcaccccgagctatga

SEQ ID NO: 3495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgaccattgaagggtgcacgacgtggcat

SEQ ID NO: 3496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgacccatcgttccgcggcttacattctg

SEQ ID NO: 3497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgactccgttttgccttgtttccagggcc

SEQ ID NO: 3498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgagggcgacagaattgcgccgcagggag

SEQ ID NO: 3499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgatacaattcgtggcttatcgcataagg

SEQ ID NO: 3500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgatcacagggacggtggcgcgttcgggc

SEQ ID NO: 3501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgatgtcagtcccgtacactgctctcctg

SEQ ID NO: 3502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgattattttcaaggttgtgttctcttgc

SEQ ID NO: 3503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcaattgtatagcgaagcccatttgaga

SEQ ID NO: 3504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcaccgaattgtgggatcggccatgggc

SEQ ID NO: 3505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcacgtgcccgagggtaagaaattgatt

SEQ ID NO: 3506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcactagcctttctctttcccgagtcgg

SEQ ID NO: 3507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcacttgcctgtatcaaacctccgctcc

SEQ ID NO: 3508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcagcaagatgtcataccgccatcgggg

SEQ ID NO: 3509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcaggagtgcgtcccccgtgtctcgcgt

SEQ ID NO: 3510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcatacacgatacataagctgaaattct

SEQ ID NO: 3511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcatcgcagtaagggtcggccgacaagg

SEQ ID NO: 3512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcatgattctaccggtaagtggctgtct

SEQ ID NO: 3513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgccatttctgtggcaacgtctccccgtt

SEQ ID NO: 3514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcccagcagtagggcgcattagtttgcc

SEQ ID NO: 3515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgccgagtggccagaatgattccggtgca

SEQ ID NO: 3516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcctccgaatgggctgtcaatcccctcg

SEQ ID NO: 3517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcgaatcacattgggcaaaccagagctg

SEQ ID NO: 3518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcgacggttaaagcttagtctataattg

SEQ ID NO: 3519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcgcactttgtagaaggttatacgtgtt

SEQ ID NO: 3520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcgcgagctaccaactttggcacacccg

SEQ ID NO: 3521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcgcgagttgatcccttggcatagactg

SEQ ID NO: 3522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcgctccccctgtaaccttccttccttc

SEQ ID NO: 3523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcggcaacgtggttgggtacgcgttatc

SEQ ID NO: 3524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcggtacggtgctagcgtattccctggg

SEQ ID NO: 3525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgcgtgtttgtccgactgtagatggaggt

SEQ ID NO: 3526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgctatttttaccgggaaggctcatggtt

SEQ ID NO: 3527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgctcccagaacgaagcttaacgcggtgt

SEQ ID NO: 3528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgctcgttttcagacctacccgggacagg

SEQ ID NO: 3529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgctctttgtgtgataagtaatcgagagc

SEQ ID NO: 3530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgctgaagtaaagcttccgttactcggga

SEQ ID NO: 3531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgctggtgtttatcatgttgtcttaaggt

SEQ ID NO: 3532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggaatacgttgttcccgagcttatttcg

SEQ ID NO: 3533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggacaccagcgtaaggccgtgccgcgtc

SEQ ID NO: 3534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggagcagtcccccattatactcgcgcgc

SEQ ID NO: 3535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggcaacacactacgggtgagagtgggaa

SEQ ID NO: 3536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggcacaggcgcattggccccgttggtat

SEQ ID NO: 3537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggcacgtgaccctgccttcccgtgctct

SEQ ID NO: 3538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggcagcggagaatcgtagttaccagggg

SEQ ID NO: 3539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggcatactagggcccggtgatgaagggg

SEQ ID NO: 3540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggccacgcttaaattgcagcacactgcg

SEQ ID NO: 3541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggcgcccacgggccttgtcagctgcatt

SEQ ID NO: 3542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggcgcgtacatcgtactcgttagcgttc

SEQ ID NO: 3543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggctcgataaagccgtttgtgtactctg

SEQ ID NO: 3544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggctgtgcacgctcgaaatcgggacagt

SEQ ID NO: 3545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgggactggtggactcttacttagatgga

SEQ ID NO: 3546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgggatcttgtcctgcggaaggctcaacc

SEQ ID NO: 3547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgggcacccccgtctaccacacttcaggg

SEQ ID NO: 3548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgggcagtttggagctttgctgctagacg

SEQ ID NO: 3549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgggcttgcaggttgcacgtttctctcgc

SEQ ID NO: 3550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgggggtgaaagtgcaggcttagattagc

SEQ ID NO: 3551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgggtcttcgacagcttacgtacggcacg

SEQ ID NO: 3552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggtaaagcttgcctactcgccttccagt

SEQ ID NO: 3553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggtcatgtcctcttgcttcatggattta

SEQ ID NO: 3554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggtcggtgggcaaaggacgacagttggt

SEQ ID NO: 3555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggtgcgctcgcttggtaggtgttacggt

SEQ ID NO: 3556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccggtggcaccgcgtagagtacgtgtgcaa

SEQ ID NO: 3557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtaaaggtctctgtatttcggaactgcg

SEQ ID NO: 3558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtagcgtcagcactgcaatccctggcgc

SEQ ID NO: 3559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtagctcaatcctcggttgtcgagtgcg

SEQ ID NO: 3560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcaccactgggaccacgtttcagacgg

SEQ ID NO: 3561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcaccgtacccgaagcccgtctacttc

SEQ ID NO: 3562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcagttgtataaagtggctcgtccgcc

SEQ ID NO: 3563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcatactcagttttggtacaccgtgcg

SEQ ID NO: 3564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcataggcgacgctggacccctagaac

SEQ ID NO: 3565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcgcgcactggtggccttaatgagtgc

SEQ ID NO: 3566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcggttgagacggccacactttcctgg

SEQ ID NO: 3567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcgtcgagttggtacattgatgattga

SEQ ID NO: 3568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtcgttgagacgttaatgcgcgatactc

SEQ ID NO: 3569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtgactgcgcacacatgttttctgtctc

SEQ ID NO: 3570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtgccaccagggaacgatggcttgtaag

SEQ ID NO: 3571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtgcgttcaccacctcctgcactgggca

SEQ ID NO: 3572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtggaagtggtggaagttaacgggcttt

SEQ ID NO: 3573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtgggagatttagccgggatcatcgtgc

SEQ ID NO: 3574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtggtactgcaaaggcaaatcgggagct

SEQ ID NO: 3575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtgtcgcgacggggacgggcttagctgc

SEQ ID NO: 3576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgttatcggggtagaggggtccccggtta

SEQ ID NO: 3577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgttcacggctctaagtagcatatattca

SEQ ID NO: 3578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgttccgtgggattcaggccaatagtcta

SEQ ID NO: 3579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgttcggtggtggacgctattctcggtgt

SEQ ID NO: 3580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgttcttctgatccgtctctacttgtagc

SEQ ID NO: 3581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtttctaatgcacggcccgtaatggacc

SEQ ID NO: 3582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccgtttgtgcgccaaggtggagttgtcggc

SEQ ID NO: 3583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctacaaatggtgccgataaagctcccgag

SEQ ID NO: 3584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctacaccggtatggcaattatgatttacc

SEQ ID NO: 3585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctagccaattaaccagcgagattctccgg

SEQ ID NO: 3586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctatggctgttcactttcacgcggctttt

SEQ ID NO: 3587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctcaaattgtaactagacatcgagtttcc

SEQ ID NO: 3588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctcactagaggcccggtaaaggcgagtgc

SEQ ID NO: 3589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctcagaatgctaccggacactaaggcaag

SEQ ID NO: 3590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctccacgtcgcgtataggtggaatctctg

SEQ ID NO: 3591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctccacttggcgagggggtgggaaactgc

SEQ ID NO: 3592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctccgtcatgatgtgttacaggatagagc

SEQ ID NO: 3593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctcgcagcatcaaacccggatacgttcac

SEQ ID NO: 3594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctcgcatgctttgtggacgctcctgtcta

SEQ ID NO: 3595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctcgctcgtaaactttgtcacaatccatc

SEQ ID NO: 3596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctcggggatgtacgtcccgtcatcttttg

SEQ ID NO: 3597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctctagttgcacgtaattttggacatctc

SEQ ID NO: 3598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctctcactttaacttcgaggcgaatggag

SEQ ID NO: 3599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctctcatcgtgtccattcacccgtccctt

SEQ ID NO: 3600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctctgccgtacatgcgacgtgatcacggt

SEQ ID NO: 3601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctgaggtgtgtcctgcctaggttgagccg

SEQ ID NO: 3602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctgcatggcttgttaaggccccggtctcg

SEQ ID NO: 3603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctgcttttcgccaaatggggtagacctct

SEQ ID NO: 3604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctggcacggcgtatattgcattttgtcta

SEQ ID NO: 3605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctggctttatggttcttatcggataagac

SEQ ID NO: 3606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctgggacgcgaagccgctgagctctgatt

SEQ ID NO: 3607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctgtccggacaatggagtatgttcgagta

SEQ ID NO: 3608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctgtctcgaaccgcgctggctagacgtgc

SEQ ID NO: 3609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttcattatcggtacttctgatggggatt

SEQ ID NO: 3610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttgaagtggggctaaggcagtatccatg

SEQ ID NO: 3611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttgagcactgttaagcgacacaacctgg

SEQ ID NO: 3612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttgcaacagacggattagaggaattcaa

SEQ ID NO: 3613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttgggacagaaagggcctatgcaacgac

SEQ ID NO: 3614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttggtcgcttcctgcttcactctgcgtt

SEQ ID NO: 3615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttgtgaatcaggtgcatgatacttaatt

SEQ ID NO: 3616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctttaacatgtccctttaatatcgggttc

SEQ ID NO: 3617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctttcacgcacgggtttgcttcggttata

SEQ ID NO: 3618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accctttgaagttagacgatacgcccaagccc

SEQ ID NO: 3619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acccttttaacgtgatgcgtttacgggcgacg

SEQ ID NO: 3620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaaaagttgacgagattgtcgaatgatct

SEQ ID NO: 3621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaaacagatggtcccgccgcctcttccct

SEQ ID NO: 3622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaaagcagggttcaccggatggctgtagc

SEQ ID NO: 3623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaaagtggccggcgcatatgacttgcgat

SEQ ID NO: 3624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaacatgccactgtattcgtgcggcgtaa

SEQ ID NO: 3625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaacgcccaggccaggatgagaggtgcaa

SEQ ID NO: 3626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaacggtactccccgactcgagctcgcac

SEQ ID NO: 3627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaactgcgatcagcacactcgacggtgtg

SEQ ID NO: 3628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaagaagggagcaaatcaccgtccagcgt

SEQ ID NO: 3629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaaggggtgtgacctgctcaacaacacgg

SEQ ID NO: 3630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaatccttgtagacccgttttgcgcgaca

SEQ ID NO: 3631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaatggcttatgtcatgcggagaggggaa

SEQ ID NO: 3632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacaaagcgccattgttggctgcatccga

SEQ ID NO: 3633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacactgggatagcggccgtgcgagctca

SEQ ID NO: 3634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacaggcaaaggccaatgctttggtagtg

SEQ ID NO: 3635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacagggtggggttcgagcttggccatca

SEQ ID NO: 3636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacagtcgcttggggagaaatacattctc

SEQ ID NO: 3637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaccgcggggcacatagttaagctctctt

SEQ ID NO: 3638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacgaaagcagtacgaagtgaacctcctg

SEQ ID NO: 3639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacgagcttttaatatcattagtggtgca

SEQ ID NO: 3640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacgaggtgccttgcggttttcgcctggt

SEQ ID NO: 3641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacgcgtcaggtggttagcgtgttaaacg

SEQ ID NO: 3642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacggcgagggaacgatttgcaacgtggc

SEQ ID NO: 3643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacggcgcaaatggacgggtagtcgtggt

SEQ ID NO: 3644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacgggacgaaaagaacggtccagcagcg

SEQ ID NO: 3645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacgtaccgcgttgatcacttggcccggt

SEQ ID NO: 3646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacgtgttgcgtgtcgagatctcacgatt

SEQ ID NO: 3647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgactagatcgtctctccagtacggccatc

SEQ ID NO: 3648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgactgctgtcagtgaatatgcaggagggg

SEQ ID NO: 3649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgactgtataacgcggatttggcggctgac

SEQ ID NO: 3650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgacttaatgcaccttgttacgtctgagat

SEQ ID NO: 3651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagaaaggcggttgaacgtggtgactctt

SEQ ID NO: 3652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagacttaggtttgtaagcgtgctactag

SEQ ID NO: 3653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagagcctgcgtttcaacgtaaaccggtg

SEQ ID NO: 3654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagatgcggaacttcccgtagttgtcagc

SEQ ID NO: 3655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagcaccacttggggccactcgtttggtc

SEQ ID NO: 3656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagcagcttacaggagagttactctacga

SEQ ID NO: 3657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagcagtaatgattttctgtcacggctgt

SEQ ID NO: 3658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagccatatgtgacaagcatgtgtggcta

SEQ ID NO: 3659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagcctcatggtttagtgggacagctacc

SEQ ID NO: 3660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagccttcttggtgttttctcataatccg

SEQ ID NO: 3661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagcgctacagcgtgggaactgcttggtc

SEQ ID NO: 3662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagcggcagaacgatacacttgggtcgac

SEQ ID NO: 3663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagctggacggatcccatgaaaacggact

SEQ ID NO: 3664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagctgtggctttagtgttgcataaggcg

SEQ ID NO: 3665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagcttgccacaggcttcatatgctgtcg

SEQ ID NO: 3666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaggagaaataatttgtatcatgtgcacg

SEQ ID NO: 3667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaggcctcaggcgtaaccttcctgattac

SEQ ID NO: 3668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaggcgtacggcatagcagcactcatacg

SEQ ID NO: 3669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaggctaaatgaattggaacatctcctat

SEQ ID NO: 3670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagggacgggctccgccattcgagggtgt

SEQ ID NO: 3671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgaggttgctgtcacgcattctgggtgagg

SEQ ID NO: 3672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagtaggtccctttccgataaacctccca

SEQ ID NO: 3673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagtccttatgcctcctttcataggtttc

SEQ ID NO: 3674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagtcgtaggcacccgtcatgcaacgtct

SEQ ID NO: 3675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagtggagtgtagctgcgtgtggtgcgtg

SEQ ID NO: 3676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagtggttggttggttcacttatttggtg

SEQ ID NO: 3677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagttccgggctgccggcagctgcttggg

SEQ ID NO: 3678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagttcgatgtttcacggcattcttgttt

SEQ ID NO: 3679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagttggacggctttatttctaccggcga

SEQ ID NO: 3680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgagtttaaacgtgtgccgggttcaatagg

SEQ ID NO: 3681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgataagttcgtgattaatagtctagcacg

SEQ ID NO: 3682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatacccaaaatcgatcaggacgcacctg

SEQ ID NO: 3683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgataccgatggttttgtgtgttcgcatgg

SEQ ID NO: 3684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatactggttgttggtatggaaaccgggc

SEQ ID NO: 3685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatagccgtccagcgtcccggcgaaacaa

SEQ ID NO: 3686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatcaggctacgattgatgcctgtcgtgg

SEQ ID NO: 3687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgaccgcggtgagggctggggcgtcgc

SEQ ID NO: 3688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgcatcgatttcccgcgacggcaatac

SEQ ID NO: 3689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgccgcacagagttatgttataccatt

SEQ ID NO: 3690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgtagtgtcatatcgtaccctttcatg

SEQ ID NO: 3691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgtgtcctccgtaccgctatatactgt

SEQ ID NO: 3692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgttgccgcctagaccgagcgtaggtt

SEQ ID NO: 3693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgttttccggacggaggaacggggcct

SEQ ID NO: 3694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatgtttttggttagtgatccagacattg

SEQ ID NO: 3695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgattaagtctatagtcccacattgaaaca

SEQ ID NO: 3696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgattaccgacgagaattcggcacttcgtc

SEQ ID NO: 3697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgattctcatagtttctcagagggtgtgta

SEQ ID NO: 3698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgatttatctttcgattggaccgcttatcg

SEQ ID NO: 3699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaaaggatacgagtccattggcttgacc

SEQ ID NO: 3700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaaatccacagttcgataagtgttgagt

SEQ ID NO: 3701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaaatctggtgcaggcgccatgttttat

SEQ ID NO: 3702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaacctttatttatctccacgtagggtg

SEQ ID NO: 3703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaacgagcaatgctcgccacactactcg

SEQ ID NO: 3704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaacggaggggacacgggcacacattct

SEQ ID NO: 3705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaaggacccattgtgcctatgaactccg

SEQ ID NO: 3706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaaggggtgttcgtactgcgacagtggg

SEQ ID NO: 3707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaataccgtaccgctggcgcagtttcgt

SEQ ID NO: 3708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaatttctatccggaactcggctgctga

SEQ ID NO: 3709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcacctggcataccttgtttgagcctcgc

SEQ ID NO: 3710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcacgagtgacgtgacgtgcacatccgcg

SEQ ID NO: 3711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcacgcctaatgtaaggatggcacctgag

SEQ ID NO: 3712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcacggcaagaaggttaactgccgcgaca

SEQ ID NO: 3713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcacgtgcctgatgtttgcaagatcaatg

SEQ ID NO: 3714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagaactctgttccttagtcttgagagc

SEQ ID NO: 3715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagaggccattttgtcccgcagttcgct

SEQ ID NO: 3716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagagtgcgatacgttgaggattgggtt

SEQ ID NO: 3717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagccaggctatggcactaggttaaatg

SEQ ID NO: 3718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagcgtgagacccaattccgaaggagcg

SEQ ID NO: 3719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagctgaacataccgagggagtcgcgtt

SEQ ID NO: 3720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagctgtctattgcccacggtgtgcatc

SEQ ID NO: 3721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagcttggtagggactacacgcccgcac

SEQ ID NO: 3722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcaggtctactgggaatcaataactcgac

SEQ ID NO: 3723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcagtattgagagataagcacgtaagcgg

SEQ ID NO: 3724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatcatgcccactatccgatcgtgtttg

SEQ ID NO: 3725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatccggaccagacccacctccggccct

SEQ ID NO: 3726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatcgtttcttttcgaggcgcagctttg

SEQ ID NO: 3727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatcttatccattactgcccgtatactt

SEQ ID NO: 3728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatgagtcaagactgtttagtgtacgct

SEQ ID NO: 3729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatgtagactgcgtatgtgcctgagccg

SEQ ID NO: 3730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatgtcactaagcggtgcccatgcaaag

SEQ ID NO: 3731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatgtctaacggagccggttgtgggcga

SEQ ID NO: 3732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcattcgattcccattatctaggttgacg

SEQ ID NO: 3733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcattctggtcgcatggtgcatgatgttt

SEQ ID NO: 3734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcatttatgaccatcctgtgccgcgtcga

SEQ ID NO: 3735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccacaccttcctcagtgctgcatatata

SEQ ID NO: 3736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccaccgagcaatcggcagttccgagtac

SEQ ID NO: 3737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccacgtacattcacttaaggccgaagca

SEQ ID NO: 3738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccacgtgagtactcggcccaatgtcggg

SEQ ID NO: 3739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccactatggaatggagatcgacatgttg

SEQ ID NO: 3740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccagggaatatctggactgggccacagg

SEQ ID NO: 3741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccaggtcgcaaatcacgaggctggatgc

SEQ ID NO: 3742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccatactattgtcgcgccagggggatca

SEQ ID NO: 3743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccatgtgtactctgcgttctggcgccgg

SEQ ID NO: 3744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcccacacaccttccgttgtacactgtgg

SEQ ID NO: 3745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcccactttcgacacgaaaatcctagttg

SEQ ID NO: 3746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcccagctcgatataggtaggttaggccg

SEQ ID NO: 3747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcccctccaacaatccggacaatagcgtg

SEQ ID NO: 3748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcccgcattgtacgtcattttccgggacc

SEQ ID NO: 3749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcccggcgtgtcgttgatgggtcggacgc

SEQ ID NO: 3750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcccgtgctcactcggctccttgatttgg

SEQ ID NO: 3751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccctgcacattacgttcgtatttcgtac

SEQ ID NO: 3752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccctgtcggaaggagtcacttcccatag

SEQ ID NO: 3753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccgaacccatccctttggggacagagat

SEQ ID NO: 3754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccgagcagggtgtacagcaacgtcatgg

SEQ ID NO: 3755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccggaactttgtaggggttgtcgggcca

SEQ ID NO: 3756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccggcagacatcgagcaaggctaatacg

SEQ ID NO: 3757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccggctggatgtagacctacagactttg

SEQ ID NO: 3758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccgttgtccattcgacgacaggggttgt

SEQ ID NO: 3759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcctaccacgtatttctgaggcatgccgc

SEQ ID NO: 3760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcctagctagctttaaaccgccagatcgc

SEQ ID NO: 3761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcctcattctgacaaactccattccagcc

SEQ ID NO: 3762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcctgctagacctcctagtgttgtcaccc

SEQ ID NO: 3763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgccttccccgagtaatcttgtttcggtgc

SEQ ID NO: 3764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgaaaactcgtctctgccactgccacgc

SEQ ID NO: 3765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgaaaggaggcactaatgcgaacgacaa

SEQ ID NO: 3766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgaatacatacgggtgaactagggcggc

SEQ ID NO: 3767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgaatcgtctaggttatcactagccacg

SEQ ID NO: 3768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgaccacgaacgcatgctagcagtacaa

SEQ ID NO: 3769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgactggtaggtggccgcaagctgctag

SEQ ID NO: 3770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgagctttcggcgaggctacaactttgg

SEQ ID NO: 3771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgataggttttagtgcgcgattgcacta

SEQ ID NO: 3772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgatcaaagactaaatttgcactttctg

SEQ ID NO: 3773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgattggtcacgcgagcctgaataaaat

SEQ ID NO: 3774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcagaagtgttggttagctctgcaacg

SEQ ID NO: 3775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcaggggaattttctcccggtagcctg

SEQ ID NO: 3776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcagtacactggagttcccgcttcggc

SEQ ID NO: 3777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcatttcccccactatagtagccaggc

SEQ ID NO: 3778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcgacaggcacaggcagagtcttgttt

SEQ ID NO: 3779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcgcgcgcaagacaaccggaccacgtc

SEQ ID NO: 3780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcgctcgatgcggttataaggggggga

SEQ ID NO: 3781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgcttgtaacgggggttgcgcaacgggt

SEQ ID NO: 3782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggaacgattatgagtatgctttaaggg

SEQ ID NO: 3783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggacatgacggcgaaagcctctgggct

SEQ ID NO: 3784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggatatgctctgtctgccggcacccgg

SEQ ID NO: 3785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggcacgttgtacgttaggacacatgag

SEQ ID NO: 3786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggcctccacgaaagcgagactcgcccg

SEQ ID NO: 3787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggctaagtattaataacacttgagcta

SEQ ID NO: 3788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgggcgttaggaagcagatggggattgt

SEQ ID NO: 3789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgggctacggtggctgtgcgcatctgtc

SEQ ID NO: 3790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggggtcagtcatgggtgtcttcaactg

SEQ ID NO: 3791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggtatctcagtcattggctgatcggtc

SEQ ID NO: 3792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcggtgtccatctagaggagcgctgggtc

SEQ ID NO: 3793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtaaaaggcagctaattagtctggaat

SEQ ID NO: 3794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtaagtatatcccagcaacgtgctgac

SEQ ID NO: 3795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtagttcgcataggggggttgctccgg

SEQ ID NO: 3796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtatggatcgttcgtggtgacaccggt

SEQ ID NO: 3797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtccatgtgaagaggagagcccgccga

SEQ ID NO: 3798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtgcagattgcaatgttctatggaccg

SEQ ID NO: 3799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtggtgtttttttccgagacaatgcgt

SEQ ID NO: 3800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgtgtagcgggaagcgttagcagcggtt

SEQ ID NO: 3801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcgttcgtaggtactgaaggccatttggg

SEQ ID NO: 3802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctaaggctctacaggctttgtaccgtcg

SEQ ID NO: 3803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctacacctctcaggagcttgcacctagg

SEQ ID NO: 3804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctagccactcttgttcccagtgaaagtg

SEQ ID NO: 3805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctagctgttgtgtaaaacttggctgttc

SEQ ID NO: 3806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctaggatcgtcaacccacacggagattg

SEQ ID NO: 3807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctatgactcgagcccgctacgtagagta

SEQ ID NO: 3808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctcaaatgtcgtcacatccctctaacga

SEQ ID NO: 3809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctcccgtaccgtctctcgcttacattct

SEQ ID NO: 3810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctccgaggtccagcttggtaggcttggt

SEQ ID NO: 3811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctcgcgaatttagtcaggcgacgtgggc

SEQ ID NO: 3812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctcggaggatcagtgctggcagctagta

SEQ ID NO: 3813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctgagatgagaaggcactgcaggtgagc

SEQ ID NO: 3814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctggctcgattctagctttgtggaagcc

SEQ ID NO: 3815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgctgtcctcgctgtggttcaggcaggcgt

SEQ ID NO: 3816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcttagcgtgggctttttcttggcacaat

SEQ ID NO: 3817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcttagtaaaacttctctccttaaccgaa

SEQ ID NO: 3818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcttagttctgtcactatagacctgagat

SEQ ID NO: 3819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgcttttaatagtgtctccttgtttgccca

SEQ ID NO: 3820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggaaagcgggtaaaccagtttcggccgtc

SEQ ID NO: 3821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggaaccgcggatgtcatccgtcgggtgtg

SEQ ID NO: 3822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggaactaaattattctgaactcgcttgaa

SEQ ID NO: 3823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggaatcaacagagctgtgcaggcaaacgt

SEQ ID NO: 3824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggacaagcgcgcggtgatgagcagggggc

SEQ ID NO: 3825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggacaccccagtcttgtcccagtcgggcc

SEQ ID NO: 3826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggacagccggttttactccttgacgcact

SEQ ID NO: 3827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggacgcaccttcgcgttgtaatggcgccg

SEQ ID NO: 3828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggacgcgtcgactatgccgctgtcgctgg

SEQ ID NO: 3829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggacgtactcgctcaccgtagaggcggtg

SEQ ID NO: 3830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggacgtttgccttcgacattgatatcggg

SEQ ID NO: 3831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggactttgcgtcagagacggcgctgcgct

SEQ ID NO: 3832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggagagtccacgtatgaggttgggcagtc

SEQ ID NO: 3833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggagcatgctaaatgctctctatggcggc

SEQ ID NO: 3834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggagcccatgaaatcacaggtctggggct

SEQ ID NO: 3835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggagcgccagcagatcctcgtctaccgtt

SEQ ID NO: 3836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggagctaggggacggcgcataacgcctgc

SEQ ID NO: 3837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggagctcgcttatcatggaaggacgtcgg

SEQ ID NO: 3838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggagggcattgggcttagctcggaacctg

SEQ ID NO: 3839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggaggtgatattacgtgataatcacgctt

SEQ ID NO: 3840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggatagcggttggaggcgtgctccactcg

SEQ ID NO: 3841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggatgcttgccggagaagacttccgaatt

SEQ ID NO: 3842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggatggggcgctatccgtggggtatgttg

SEQ ID NO: 3843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggatggtggatttttttcctcgcgcttca

SEQ ID NO: 3844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcaaaacacagcctctggtctgggcccg

SEQ ID NO: 3845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcaatttgtatatctgcgcggttttggg

SEQ ID NO: 3846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcacagagatgaatagttggccgcttaa

SEQ ID NO: 3847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcactggcctgtctatttgcacgcgctt

SEQ ID NO: 3848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcagctgaggaatagatttttaggcaaa

SEQ ID NO: 3849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcaggatcagacggtttggttgctaacc

SEQ ID NO: 3850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcaggtacggacactcactagggtctgt

SEQ ID NO: 3851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccaagttgaagagcgaggtagcgttgc

SEQ ID NO: 3852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccaattgaacactggtgcttggacgac

SEQ ID NO: 3853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccagccgtaccaacgccacacgcgtca

SEQ ID NO: 3854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccaggactgcagggggaagtggacgcg

SEQ ID NO: 3855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccaggttcgtggagtttctgattgtgc

SEQ ID NO: 3856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccatcggaagcgccagcgatgctcgta

SEQ ID NO: 3857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccatctacgtagaggtccgaatgggtt

SEQ ID NO: 3858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcccccccgtaacaggcacttgtattcg

SEQ ID NO: 3859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcccccctggctcaactatgctctggtg

SEQ ID NO: 3860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccctcacaacccgtggcgcaacttccg

SEQ ID NO: 3861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccgacagtcaagcacgaggattacgtt

SEQ ID NO: 3862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccgatcgtggcgtaccaacgtaactcg

SEQ ID NO: 3863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccgcctcaatgcgggaccctagcgcgt

SEQ ID NO: 3864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggccggtcaaagacgcccacggtcaccgg

SEQ ID NO: 3865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcgaaaggctccttacttcgtgctaggt

SEQ ID NO: 3866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcgcacgagggtcgaccttagagacggt

SEQ ID NO: 3867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcgccccctcaaagctaatgggtagtat

SEQ ID NO: 3868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcgtaacgcatgatcagacacaggagcg

SEQ ID NO: 3869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcgtaggcgcattaatcgggccctggtc

SEQ ID NO: 3870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcgtttctgtgaccttgtgccctctcct

SEQ ID NO: 3871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctaatggcaggcgttcgggtgcgatga

SEQ ID NO: 3872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctagaggtgccgatgcgacgggtaata

SEQ ID NO: 3873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctatcacgcacatatgccagaagaacg

SEQ ID NO: 3874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctatctcgattcagggggaatcagcgc

SEQ ID NO: 3875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctattggggaggcgaggcgggaatgat

SEQ ID NO: 3876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctcggtagactacggttaaggtccttg

SEQ ID NO: 3877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctcttctgggctccttgcttgctatgt

SEQ ID NO: 3878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcttaggacagcctcgacccgatgcttc

SEQ ID NO: 3879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcttgggaggcgttgtcatgatcccttc

SEQ ID NO: 3880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggcttggggatgaccgtgtcggcaccctg

SEQ ID NO: 3881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggctttcgattggtatccatttgggatct

SEQ ID NO: 3882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggaaattaggtaatagctttcgataggt

SEQ ID NO: 3883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggaacacgactgtaccaccctaacccgt

SEQ ID NO: 3884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggacctgtgttctcgggtgtgcggcggt

SEQ ID NO: 3885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggacgaaaccgttaaatgcgcgcgtgcg

SEQ ID NO: 3886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggagaagaggccgcccagtgtattggcc

SEQ ID NO: 3887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggaggcttcgtcaactgctgcttggagg

SEQ ID NO: 3888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggagggtcggaccactccatccctttgg

SEQ ID NO: 3889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggatcaatgtgacaagcagattggttct

SEQ ID NO: 3890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggattgggcttgctgtttggcgcactcg

SEQ ID NO: 3891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcaattcgtggacatcatcaattgggc

SEQ ID NO: 3892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcataccggggctccgtcgcacccctg

SEQ ID NO: 3893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcatataaaacatcgccacctagccga

SEQ ID NO: 3894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcatcaactgactagattcgtccattg

SEQ ID NO: 3895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcccatccgacatgcatgttccctttt

SEQ ID NO: 3896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcgcgaataaggctaagccatggctag

SEQ ID NO: 3897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcgctgcaacggttattgtacgagatg

SEQ ID NO: 3898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggcgggaccgacgtacgaccgctgcggg

SEQ ID NO: 3899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggctccagattcatccttataccctaac

SEQ ID NO: 3900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggctgggggttaaacgctcgattcgagg

SEQ ID NO: 3901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggaataagccaattaaaccgcgtactg

SEQ ID NO: 3902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggacatgacgtttacgctctacacgtg

SEQ ID NO: 3903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggacggaaaatgtctcttctggcggga

SEQ ID NO: 3904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggacgtgggcgttggttacgatggata

SEQ ID NO: 3905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggatcgcacatgacccgctgcgtctcg

SEQ ID NO: 3906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggcatcatggctttcggactcggtgta

SEQ ID NO: 3907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggcatcgccgaggaacagctgcaaatc

SEQ ID NO: 3908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggcgggcggtgcagaaccgtaagatgc

SEQ ID NO: 3909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggcgtgggcttagtcagtcgggaagcc

SEQ ID NO: 3910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggcgttgcagataggaattgccgcctt

SEQ ID NO: 3911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggggtgtatggagggtggcgcggggtat

SEQ ID NO: 3912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggtaaacgctgtcgatggattccactt

SEQ ID NO: 3913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggtatgacgagtgttcactaagtgttg

SEQ ID NO: 3914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggtctcccgtacactgttggctagggg

SEQ ID NO: 3915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggggtgcagctcctgtttttacacgccga

SEQ ID NO: 3916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggtagatctccactcgcataagtgacgg

SEQ ID NO: 3917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggtagtacaatcctccagtgagattctc

SEQ ID NO: 3918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggtgaatgtcaactccagggttagcggc

SEQ ID NO: 3919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggtgatataacgaggaatatcgcaggcc

SEQ ID NO: 3920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggtgccgtcctgcgtcccctccctccgt

SEQ ID NO: 3921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggttaggttatacggagattctttcttc

SEQ ID NO: 3922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggttatgtgccgacgagttcctcgtgac

SEQ ID NO: 3923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggttccgggctccttggacttacgtgga

SEQ ID NO: 3924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggttcggagcctgcacttcaattcccca

SEQ ID NO: 3925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggttctatttagtaccgcccgtaacgga

SEQ ID NO: 3926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgggttgaatgcagcgtctcgccggatcta

SEQ ID NO: 3927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtaacgttgcgtggcctgctcgttgcga

SEQ ID NO: 3928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtacaagactgaagctccatgtcctttc

SEQ ID NO: 3929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtacaggctgtgtgttatgctgctgccc

SEQ ID NO: 3930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtacggcgtcgcgtacgtagcgtaggcc

SEQ ID NO: 3931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtacgggtaagccataatagggatatct

SEQ ID NO: 3932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtagagggcgcgtcaatactcttcggag

SEQ ID NO: 3933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtaggcgctcggggtagtttcggccata

SEQ ID NO: 3934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtagtcaacgtatttattgccgttcgcc

SEQ ID NO: 3935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtataagcagcgtgacagtggatgccgg

SEQ ID NO: 3936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtatcaaagccaggtatcgcgccgattg

SEQ ID NO: 3937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtatgcgtagtttattaaggtgaaatcg

SEQ ID NO: 3938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtatgtaggttgggcttgcacggtttaa

SEQ ID NO: 3939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtcaatggtggtgtggaacatgcaaccc

SEQ ID NO: 3940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtcacgtagtactcataagtggcgcccc

SEQ ID NO: 3941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtcactgtaagagtatggtaaatgccga

SEQ ID NO: 3942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtccggttacgctcaacacactagactg

SEQ ID NO: 3943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtctaccagcttgatcgatttttcgctt

SEQ ID NO: 3944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtcttgccttctctcggacagttcgaac

SEQ ID NO: 3945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtgcaggagtttacagtcgacgtatgga

SEQ ID NO: 3946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtgccttgagtcgcggggtaggtttggc

SEQ ID NO: 3947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtgccttggtgccaaggggccacatcaa

SEQ ID NO: 3948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtgcggtgcatcgccgacacaaatgggt

SEQ ID NO: 3949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtggaaccatccctttacgtcctgggca

SEQ ID NO: 3950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtgggaggtggaggtagtccaaaaaact

SEQ ID NO: 3951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtgggtgcttttatggttctcgtacgct

SEQ ID NO: 3952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtgtcggactgcgtctagggcaggggta

SEQ ID NO: 3953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggttaccagcatggggttatctaggcacc

SEQ ID NO: 3954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggttcaagggcccctgcgtcggtgtcgcg

SEQ ID NO: 3955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggttggcacgcagattaagggtctaattg

SEQ ID NO: 3956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggttggttcgatctcctgttgaagtcagc

SEQ ID NO: 3957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtttaagttcaacagaccaagggtaacg

SEQ ID NO: 3958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggtttgggggtggagccgacgtggaatga

SEQ ID NO: 3959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accggttttagtctctatccacatcggggcta

SEQ ID NO: 3960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtaaaataataggatatagatcgggagcc

SEQ ID NO: 3961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtaagcggataagaccgaagtaatcaacg

SEQ ID NO: 3962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtaagtcctttaatagcctcgtactctcg

SEQ ID NO: 3963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtacagcgcaagggcgggtcggtatccct

SEQ ID NO: 3964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtacaggtgtgacttaggttaatgatctt

SEQ ID NO: 3965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtaccaaagagatcttggcgtcacttttg

SEQ ID NO: 3966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtacctcccgctgacttgaacaccgcctc

SEQ ID NO: 3967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtaccttctggggaaacagcgcaatggta

SEQ ID NO: 3968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtacgaaactgaggatgcgatgcggaacg

SEQ ID NO: 3969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtagatacgtgggagtacatcaatcggaa

SEQ ID NO: 3970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtagcggtgcgggagttgcctggggcggt

SEQ ID NO: 3971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtagggcaggattcgtgtactggctatgc

SEQ ID NO: 3972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtaggtatggcttggtcacttacggcaag

SEQ ID NO: 3973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtagtgcttgggacaatagtaccatgcgt

SEQ ID NO: 3974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtatatggtttttctcccatcattcagct

SEQ ID NO: 3975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtatgcaagcgaatgactacgcggtcttc

SEQ ID NO: 3976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcaaatgcaactcagaaaggacagtgcg

SEQ ID NO: 3977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcacaactgaaagatggcactaggcgtg

SEQ ID NO: 3978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcacgagtgtcgcccccatttcccaaca

SEQ ID NO: 3979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcagcgtaagagatctggaccgtgcgcg

SEQ ID NO: 3980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcaggagtcgagaagagtgccgatgtcg

SEQ ID NO: 3981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcatccacgacgatactcttgggtgata

SEQ ID NO: 3982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcatgccatgggcggatctcaggactcg

SEQ ID NO: 3983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtccagcgtatacatggtccgtacgttaa

SEQ ID NO: 3984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcctcgtgaaagtggctatagcgggcta

SEQ ID NO: 3985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgactatgatgtggtacggcgcaggag

SEQ ID NO: 3986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgagtagggacggcttcgggatcccgg

SEQ ID NO: 3987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgatcggggcgacccatcgcgcggggg

SEQ ID NO: 3988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgcaaaggagttccgtttctgaaggct

SEQ ID NO: 3989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgcgatgcagccaatttggtaactgga

SEQ ID NO: 3990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgcgtattttgccggtcgttttcgtcc

SEQ ID NO: 3991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgcttggggcgtgttgactcgttcgta

SEQ ID NO: 3992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcggcttgcgtgagctggacgagttatg

SEQ ID NO: 3993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgttacaggcgccaccccgcagtactc

SEQ ID NO: 3994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcgttctaggcaccgtcgcggctcgtgt

SEQ ID NO: 3995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctacatgcttcatccatggtgtagtat

SEQ ID NO: 3996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctcgaaatagggataatcaagcctccg

SEQ ID NO: 3997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctcgggtcggcagccgctgtatctcgt

SEQ ID NO: 3998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctctgccccttacgagagtgcgcctac

SEQ ID NO: 3999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctcttcaagtcgtccgcaattctgatg

SEQ ID NO: 4000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctgggacgagtactttaccgtcaggca

SEQ ID NO: 4001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctggtaaagaatgaggatccgcggtac

SEQ ID NO: 4002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcttagcgctcaggttatcccgctatgt

SEQ ID NO: 4003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtcttcgtacttgcgtggccttcacatgg

SEQ ID NO: 4004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtctttactcgtgattgtgttagtgccgt

SEQ ID NO: 4005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgaattaatccatacccgcttagatgga

SEQ ID NO: 4006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgacgactgggtaagaacagccccgcgg

SEQ ID NO: 4007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgagctcagacgcggataggtacaggcg

SEQ ID NO: 4008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgaggacagcaccgggtagaggccttgc

SEQ ID NO: 4009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgagtgttattaggggctcatacaggtg

SEQ ID NO: 4010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgagttggcgaaactgggatgcgtggcg

SEQ ID NO: 4011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgatcgtctcgcttacagccgtttaact

SEQ ID NO: 4012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgatgtgcctcccgacgtattggccctc

SEQ ID NO: 4013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgattgatatggcgcgccacaaacggat

SEQ ID NO: 4014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgccaccctcgacgtcaaccatcttcgg

SEQ ID NO: 4015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgcggatgcgacaaggattccggcatgt

SEQ ID NO: 4016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgcggggaaccagcggcttatggtgggg

SEQ ID NO: 4017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgcgttgcgatcgccagagccacattgg

SEQ ID NO: 4018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgctcggtgaccatgtcgccgacacagc

SEQ ID NO: 4019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgctctctgtgcgagataagaaacgtcg

SEQ ID NO: 4020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgcttaactcgtttgctttacactgtgc

SEQ ID NO: 4021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggacaggcgcactttatggcagcctta

SEQ ID NO: 4022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggacgcaccattgcactgttaagggtc

SEQ ID NO: 4023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggaggttggctttttggctagcttcgg

SEQ ID NO: 4024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggcagcatttaagcatagtaacaatgg

SEQ ID NO: 4025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggcatcctgtcttatgttcaatcttta

SEQ ID NO: 4026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggccgcagattcacgtgtgccgcctcc

SEQ ID NO: 4027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggcgggagtctacaaataagatcctgg

SEQ ID NO: 4028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggtaggtacaatctgccaggagagcct

SEQ ID NO: 4029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtggtcctccgctggtctgcatatcggtt

SEQ ID NO: 4030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgtaagtaatgcgtctttaccatttggt

SEQ ID NO: 4031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgtccgcaatggcaggaggtccggactc

SEQ ID NO: 4032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgtcctcttctcttctggatccatgtgt

SEQ ID NO: 4033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgtcggatttccatcaggggtcgacgac

SEQ ID NO: 4034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgtggtggagatggttgatgccttgacg

SEQ ID NO: 4035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgttcgccaaacgtagttaacagatatc

SEQ ID NO: 4036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtgttgaaatggcgttgggctattgctcc

SEQ ID NO: 4037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttaatcccgttggacggttgacagtcgt

SEQ ID NO: 4038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttacgcgttaatcgtatcaagcttgtcg

SEQ ID NO: 4039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttagcccgccatgctcgagtccagtgtg

SEQ ID NO: 4040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttaggaaattggctgtggcgtcgtgtgc

SEQ ID NO: 4041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttaggaccaccctcgatcaaggcctccg

SEQ ID NO: 4042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttatcggctgttgtcttctctccgcttt

SEQ ID NO: 4043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttatctttttacccgcaaaaggacgtac

SEQ ID NO: 4044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttatgaactagtaatagtaggttaagga

SEQ ID NO: 4045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttcaggcagaacttaaggaagtttaggc

SEQ ID NO: 4046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttcattttcagtggtcctgacggcggag

SEQ ID NO: 4047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttccattgtaacgcctatctacacgggg

SEQ ID NO: 4048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttccgagtgtaggagccggatccagcat

SEQ ID NO: 4049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttcctgcatcgcatttgcctaaccttag

SEQ ID NO: 4050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttcctgtatatacctcaatcgtctcttt

SEQ ID NO: 4051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttgaccgcctcaaactgccgctggggta

SEQ ID NO: 4052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttgaccgttgcagtacgacgcgaacagt

SEQ ID NO: 4053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttgccgaattaatgtccgggcctatcta

SEQ ID NO: 4054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttggcctgaagttattcccacgtgcgaa

SEQ ID NO: 4055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttggctccgtcacgggcatcaagtggcg

SEQ ID NO: 4056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttgggctgagacagcctgatgccggcaa

SEQ ID NO: 4057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttgttgaccaggagccttctacagtgcg

SEQ ID NO: 4058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttgttgtgctttatagaagtttcgtagg

SEQ ID NO: 4059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttgtttgcgcgatactcaaggttcaagc

SEQ ID NO: 4060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtttaacacttggaagatgctgaagcgtt

SEQ ID NO: 4061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtttaacatcctgggtatgcagccttttc

SEQ ID NO: 4062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtttactcatcgtgttaatatgttgttat

SEQ ID NO: 4063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtttattagtagtgtttgcgaaaaaggta

SEQ ID NO: 4064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtttgccagaaggatttcatccgttgtta

SEQ ID NO: 4065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtttgtggagggtgcactgacgcttcgtt

SEQ ID NO: 4066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgtttgttttgccaagggcacgaggcgtgc

SEQ ID NO: 4067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accgttttttctacatcgttttctctttggcg

SEQ ID NO: 4068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaaaccgcgaggaatgtagcaccacgggc

SEQ ID NO: 4069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaactgaactcgatcgtttacaggtagac

SEQ ID NO: 4070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaaggcacgtcttcagctgctctgtgtgg

SEQ ID NO: 4071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaagggttattgccgattagcctggcgca

SEQ ID NO: 4072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctacagattggtttcgacgatgcgggggct

SEQ ID NO: 4073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaccataaacattggccttccatttctgc

SEQ ID NO: 4074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaccgtcggcaacgcaatctctacgtcta

SEQ ID NO: 4075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctacgacatgcctcgttcatcgctggccat

SEQ ID NO: 4076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctacgtaacgggtagtgttggctgcgtggg

SEQ ID NO: 4077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctacgtgcaagctggggattgtattggttt

SEQ ID NO: 4078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctactgctctaccttccccgcgcctgcttg

SEQ ID NO: 4079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagatatcatgttacggtatggggcaccg

SEQ ID NO: 4080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagcaagtcgcgcgcaagcacaactcttg

SEQ ID NO: 4081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagcagtgcaagcaggtgtcgtactgacg

SEQ ID NO: 4082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagccaagcggtgataacttacgcacttc

SEQ ID NO: 4083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagctatgacgcttcgggtatcaatggcg

SEQ ID NO: 4084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaggccatgcgaccacgctcagggaacgc

SEQ ID NO: 4085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctaggtagataaattggttggtttttcctc

SEQ ID NO: 4086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagtctggatcactagtgtgtggatgcgt

SEQ ID NO: 4087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagtgagcagtgcaggccgatcttggtcc

SEQ ID NO: 4088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagtgctactcggtgtattttcggtgggg

SEQ ID NO: 4089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctagttgagcgatatcactgacatgggatt

SEQ ID NO: 4090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctataaggtgaaggggacttcgctgtgacc

SEQ ID NO: 4091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctataatctccattctcaagtcgggtaacg

SEQ ID NO: 4092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctataggcgtaaactgcaaaagactttagc

SEQ ID NO: 4093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctatcaaacagcagtggttccggtatgggg

SEQ ID NO: 4094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctatccggttctatattgcgcgaagcaagg

SEQ ID NO: 4095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctatgggtcggcacttatgcagagatcgaa

SEQ ID NO: 4096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctatggtcgttccacgtatcataaatctgg

SEQ ID NO: 4097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctatggtttggcggcggctgggttgcaggt

SEQ ID NO: 4098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctattccgcttatcagtgcgttctgtggaa

SEQ ID NO: 4099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctattgttgagcgaatccccaccttgttag

SEQ ID NO: 4100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcaaagtctctgttttccttctatcggtg

SEQ ID NO: 4101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcaagctctggctgtatcccgctatgcta

SEQ ID NO: 4102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcaaggtggagttcgggcgggcctctgac

SEQ ID NO: 4103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcaccgtgatatctgccctgctcagggtg

SEQ ID NO: 4104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcacgcgacactcaagcggttcgcagttg

SEQ ID NO: 4105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcacgctctgctgcacgactccgtccaac

SEQ ID NO: 4106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcactcggattatggtacctgccatcaac

SEQ ID NO: 4107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcagacggcgtttggcctcacctagctgt

SEQ ID NO: 4108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcagagctggtagcgagcacagttggctg

SEQ ID NO: 4109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcagccgattcagatcagacagccggacg

SEQ ID NO: 4110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcaggcgaatgagaccgttgaagtacctt

SEQ ID NO: 4111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcagggtagtataaatcaggttgtcagcg

SEQ ID NO: 4112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcagtctcgttttatgaactacttgctcg

SEQ ID NO: 4113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcatcaactcagggttaagggagtattac

SEQ ID NO: 4114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccaacagacgatagagcaactgctgcgt

SEQ ID NO: 4115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccactattagagccttgaacgctataaa

SEQ ID NO: 4116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccaggggggatccagctaaaacagtgac

SEQ ID NO: 4117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccagtcaggtgcaatcgagtcttctacg

SEQ ID NO: 4118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccatccccgtataatacacccggtaaac

SEQ ID NO: 4119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccatggctagacgtattgcggagaggtg

SEQ ID NO: 4120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccccatcggatctaccatggaatagggt

SEQ ID NO: 4121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcccggcacttcgagaccgcgccagattg

SEQ ID NO: 4122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccgggtcactcgggctgcggcacacgag

SEQ ID NO: 4123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctccggtcagtactgcttcctgagccgcta

SEQ ID NO: 4124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcctcatctgtacaggcgctttgcaataa

SEQ ID NO: 4125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcctctgccggtctccgtcatcttaccgt

SEQ ID NO: 4126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcctgattcgtaaggctaacaatagagta

SEQ ID NO: 4127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcctttaattcgacttgattccagtgcgg

SEQ ID NO: 4128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgagttggccactttctgtctgatggcg

SEQ ID NO: 4129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgattatgattacgataacgaatgtctc

SEQ ID NO: 4130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgcaatactatttaggagaaccggatta

SEQ ID NO: 4131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgcagaagagaacggagcaggtccgctg

SEQ ID NO: 4132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgcatggcttgaacgtcggcatcgtggt

SEQ ID NO: 4133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgccgacgtgcctcatctctggcaacgg

SEQ ID NO: 4134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgccgcaagagttcactcattcatgagc

SEQ ID NO: 4135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgcgagaaccaggcactctcaataggga

SEQ ID NO: 4136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgcgggaatgcaaaatcaacgctagctg

SEQ ID NO: 4137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgcgtttcgggctgggttttatcgttcg

SEQ ID NO: 4138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgctagggacaacattacggccgggcta

SEQ ID NO: 4139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgctcacacggccaggcagcaatcagtc

SEQ ID NO: 4140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgctgccttagtaagttaacgagccata

SEQ ID NO: 4141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcggactcaacagatcttcatgtggttat

SEQ ID NO: 4142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcggagggggcttcctgttacgatacctg

SEQ ID NO: 4143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcggcctaaggggcggctcctgtcagtgg

SEQ ID NO: 4144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgggcacataccgttgcattcccgctct

SEQ ID NO: 4145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcggggatgtcggaatcgggtttgggggg

SEQ ID NO: 4146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcggtgttagcgccacgtcactggtatgg

SEQ ID NO: 4147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgtccgcgcatcaattactatgcccagc

SEQ ID NO: 4148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgtcggccgatgcctcgaaattaccggg

SEQ ID NO: 4149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgtgcggtctttacggcatggtagcccg

SEQ ID NO: 4150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgtgggctcgattcatacggtgtttgcc

SEQ ID NO: 4151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcgttgtgtttgcttgttagacatttggg

SEQ ID NO: 4152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctaagtggcacccactcaccggtcggtc

SEQ ID NO: 4153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctaggccatatcttcgaacgcggcatcg

SEQ ID NO: 4154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctatccggtaatttgtagaggtgaattg

SEQ ID NO: 4155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctatgccgtggtatggttcatattctaa

SEQ ID NO: 4156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctcaggctgcctgccactccgatgccgg

SEQ ID NO: 4157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctcgacaaattatggtacgtaccgctcg

SEQ ID NO: 4158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctcgtgtcagtgtagtacgggttcgtcg

SEQ ID NO: 4159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctgaactgtagtctttccaggccgctcc

SEQ ID NO: 4160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctgatatgtcgggatttcaactggatac

SEQ ID NO: 4161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctgctagtgttagctttctgtggagtta

SEQ ID NO: 4162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctggagtctagcaagatttgctccaaga

SEQ ID NO: 4163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctggtatctcgactgagcaatatcttcg

SEQ ID NO: 4164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctgtgccgtctttaacttgtaagcgtgc

SEQ ID NO: 4165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcttcgtggagcgcaaggggtttggtccg

SEQ ID NO: 4166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcttgcaatattatgctacgatatcgcct

SEQ ID NO: 4167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcttgcgtctcctaacctagcttccgcat

SEQ ID NO: 4168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcttggatcgctgcgccgcggtggggtgt

SEQ ID NO: 4169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctcttggcaatggacgctaagtactggctg

SEQ ID NO: 4170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctctttctggttctagtatctgcagctcat

SEQ ID NO: 4171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgaaaatagccgcaggggatggaggggtg

SEQ ID NO: 4172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgaaggcggggcgcctcgccacaatgatg

SEQ ID NO: 4173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgaccttttgcgcttactaatcgatgtcc

SEQ ID NO: 4174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgacgttttttctgtcgtcaccaccttcg

SEQ ID NO: 4175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgactttaaggctcattagatttcgcgta

SEQ ID NO: 4176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgagagtagagcgccttcagatggccaga

SEQ ID NO: 4177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgagccaaagcttgcggacccgatcccca

SEQ ID NO: 4178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgaggggaacggaccgcgactatttcgac

SEQ ID NO: 4179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgatcacagtgacatcgattcaatccgcc

SEQ ID NO: 4180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgatcatattgtatttaagtctaggaagg

SEQ ID NO: 4181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgatcattttggcccgattttgatcattg

SEQ ID NO: 4182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgatcgtgcgagtctgcatgccttacttc

SEQ ID NO: 4183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgatgttgaacatatacgcggttcagttt

SEQ ID NO: 4184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcatgcctaagttttgcctacgtagctg

SEQ ID NO: 4185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgccaaggaattcgccgctgcgttactag

SEQ ID NO: 4186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcccaggtcggccagagcgaacgggatg

SEQ ID NO: 4187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgccccatgtcacagttgctgatccttgc

SEQ ID NO: 4188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgccctcacatcttatatccataaccttg

SEQ ID NO: 4189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgccgcgacccgaggttttgcagggcttc

SEQ ID NO: 4190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcgatgatcttctttcacaatacgtccg

SEQ ID NO: 4191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcgctgcgaccgcactctctgggtgtgt

SEQ ID NO: 4192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcggggatgattcgctggtcaacggcgg

SEQ ID NO: 4193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcgtcttctcaagcatttctgaaaccct

SEQ ID NO: 4194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcgtgcgacgtcgtctggtttcgaatca

SEQ ID NO: 4195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgctacagggggagaaccgatacggtgtt

SEQ ID NO: 4196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgctcccttatttcgccgtactgtgttag

SEQ ID NO: 4197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgctctgccttagcgtctggggaccccac

SEQ ID NO: 4198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgcttgcgaataccaacacaatgagcata

SEQ ID NO: 4199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgctttattgacacggtaccggtgactgc

SEQ ID NO: 4200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggaccgtcctcgatgagtttgccattga

SEQ ID NO: 4201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggacgcgtaaatgccgtcacgtctgttc

SEQ ID NO: 4202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggactcgtaggaggtggcgatgtgtccc

SEQ ID NO: 4203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggagtgctagttccaagatacgatgccg

SEQ ID NO: 4204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggccgaaccgctgtctgtgcgcctccct

SEQ ID NO: 4205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggccgatagggctttcaccgtcagcttc

SEQ ID NO: 4206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggctatcccattatggttcgtgcaagtt

SEQ ID NO: 4207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggctccggccaattgtcgaagtgctcca

SEQ ID NO: 4208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggctcgcgatcggctctgtaggacgtgt

SEQ ID NO: 4209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgggagaggcacaccggcaatgcacgggg

SEQ ID NO: 4210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgggaggacccgctcgtccccagtcgaaa

SEQ ID NO: 4211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgggcccacgggtttagctcgagaccttg

SEQ ID NO: 4212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggggaatggagagcaaccgtttccatgc

SEQ ID NO: 4213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggggtgttgacgatttgccatagctcca

SEQ ID NO: 4214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgggtgctgtccctgtcgctaaggtgcgt

SEQ ID NO: 4215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggtgccagctgcaacattgacggtcaat

SEQ ID NO: 4216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggtgcggcgtggaccggttagatccctg

SEQ ID NO: 4217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctggtgtacgtgcttactgtggcggcacat

SEQ ID NO: 4218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtaaatacgtggacaagaccgagtgcgc

SEQ ID NO: 4219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtacccgggatgcgtcttcatgtcttac

SEQ ID NO: 4220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtacgacattggattcaacgggaaggcg

SEQ ID NO: 4221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtactgtcgaatctcacggtttttggca

SEQ ID NO: 4222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtccgtggtttcgtcgatggcgatctcg

SEQ ID NO: 4223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtcgattaagtggtgcgggttggcggga

SEQ ID NO: 4224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtcggacgattgcggtttatacttcccc

SEQ ID NO: 4225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtgaaccccccacgatggcgcgagtgga

SEQ ID NO: 4226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtgatgaatttagtgcacacgaggtgtt

SEQ ID NO: 4227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtgcagcaagctattggttcttgggtga

SEQ ID NO: 4228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgtgtgacggctatcaatcaggggccaag

SEQ ID NO: 4229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgttaaactagcggtttcaggaatcgcga

SEQ ID NO: 4230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgttaccttatagaccatggttggaactg

SEQ ID NO: 4231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctgttgcattatctccattttagaagaacg

SEQ ID NO: 4232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaaagagggagtacgtcatacctggtac

SEQ ID NO: 4233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaaattacggatttgagttgtgattggc

SEQ ID NO: 4234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaacccattggtatcatggccacagtat

SEQ ID NO: 4235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaacggtactgctcgctacttgatggtc

SEQ ID NO: 4236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaatacatgcttattatctgcgtcctga

SEQ ID NO: 4237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaatagtaactgtcgttcgtaaaaagag

SEQ ID NO: 4238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaccactcccgcaggccctatgcgcctg

SEQ ID NO: 4239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaccttcatcgagttcccctgcggttat

SEQ ID NO: 4240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttacgccggggtactaagcctctggtggc

SEQ ID NO: 4241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttactgtcgacgtactgcttacggacgct

SEQ ID NO: 4242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttaggcgtaacgagctgcagttccctgcg

SEQ ID NO: 4243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttatcctcaaggcgattcttgcggtattg

SEQ ID NO: 4244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttatcggttatattacttttgactgttga

SEQ ID NO: 4245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcacatatgatgactgttacatggcagg

SEQ ID NO: 4246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcacctttacgctctaacagagagcttt

SEQ ID NO: 4247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcactgcctctcggaccttggggcgtag

SEQ ID NO: 4248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcagcagtggccggatgctatgacatgg

SEQ ID NO: 4249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttccatcggagcacgagtcttcagccctg

SEQ ID NO: 4250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcccccaaacacaggactgacctctgtc

SEQ ID NO: 4251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcgattctgaccttttcgttcaagtccg

SEQ ID NO: 4252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcgggtatcacgacccgtcgaactgttg

SEQ ID NO: 4253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttctacaagtcgccctcgccgcgctaatg

SEQ ID NO: 4254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttcttcacttctttgctaccgactttgca

SEQ ID NO: 4255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttctttaatgtattgcatattgttagatc

SEQ ID NO: 4256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgaaagctccaaatcttcatgttgattt

SEQ ID NO: 4257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgaagcaagtaccttctgctctgcacgc

SEQ ID NO: 4258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgacaagggataagaaggtgcggacaaa

SEQ ID NO: 4259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgagccagcataacctggagacctcttc

SEQ ID NO: 4260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgattgtataccccccagcagtaagagt

SEQ ID NO: 4261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgcatccttggcctgtcggagcgatcgt

SEQ ID NO: 4262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgcatttcgtctgtggactagccttggg

SEQ ID NO: 4263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgccgtacgccctcttttgcgcggcggt

SEQ ID NO: 4264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgcgctgggtggaattcttggcggtgtt

SEQ ID NO: 4265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgcgtgcggggcggtcatagcgtggtac

SEQ ID NO: 4266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttggatgtacccgcctctcggtcttgctt

SEQ ID NO: 4267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttggctagcacgtgattgtgtcttgtctt

SEQ ID NO: 4268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgggtggagacgctttctatccacggtc

SEQ ID NO: 4269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttggtagctcacacagtttacccgttggt

SEQ ID NO: 4270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttgtgtcgtcggtgttgtaacacagggca

SEQ ID NO: 4271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttacataccaagtatgaacacattgttg

SEQ ID NO: 4272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttacgtatgtctgtacccagtagtctac

SEQ ID NO: 4273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttagtagctaatattttggcgctttagg

SEQ ID NO: 4274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttcattaagtgagtgggagttggggctg

SEQ ID NO: 4275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttcattttactccaattcgatattaggg

SEQ ID NO: 4276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttcgaagcgtcctgcccttagtaccttt

SEQ ID NO: 4277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttgaggggaggccagatggtatttatgc

SEQ ID NO: 4278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttgcagaaactaaggttaatatttaccc

SEQ ID NO: 4279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttgccgccgcgggtgcgacacgtcacat

SEQ ID NO: 4280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttggcatcatctcacttcgttgggaagg

SEQ ID NO: 4281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acctttgtgcaggatgatctaccaggatggca

SEQ ID NO: 4282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttttaatggaattaggtgttgcagcagta

SEQ ID NO: 4283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttttatgtcatgctatccacgttggttcg

SEQ ID NO: 4284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
accttttgctcctaatcttttacgagtgcctc

SEQ ID NO: 4285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaaagtacactaggaggcgtgcgtaaaat

SEQ ID NO: 4286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaaagtatgtcgaagtgcatctattttgc

SEQ ID NO: 4287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaacccactagcgcaggggtctgtgttgc

SEQ ID NO: 4288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaacccgaactgccagaacctcgtccaac

SEQ ID NO: 4289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaacgattggcattcagcgattgattccg

SEQ ID NO: 4290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaagagccatactgtacagccactccccg

SEQ ID NO: 4291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaagcatatcgtggtggcactcaagttgt

SEQ ID NO: 4292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaaggaggcacaggattcggatcttacac

SEQ ID NO: 4293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaaggattacacagcgtgggttcgtgggt

SEQ ID NO: 4294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaagtaccttcaggaagtggtgggtggtg

SEQ ID NO: 4295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaagttggccgtcgcttggtccgttgcgt

SEQ ID NO: 4296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacaaccagcagttgcggagttgctccac

SEQ ID NO: 4297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacaaccatatgccgaagctagtgccata

SEQ ID NO: 4298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacaaccccgtagtccaggaggtctgccg

SEQ ID NO: 4299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacaacggtgttctcgatgacatgtccgg

SEQ ID NO: 4300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacaagtgaccatctgaactgcctgtgct

SEQ ID NO: 4301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacacggtcgaggtgcatgtgcaaagagc

SEQ ID NO: 4302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacataggaatcgcgatcgcaaatggttg

SEQ ID NO: 4303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaccacaacttatcgcgggagggtgcggg

SEQ ID NO: 4304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaccacgtcttccggtatacggttagtta

SEQ ID NO: 4305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaccagaactcatttgaatgaattgccgc

SEQ ID NO: 4306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaccataggagtaaggctggtagtagcaa

SEQ ID NO: 4307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacccaccctgttgctacatcgcagcatc

SEQ ID NO: 4308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacccgggcaaagacctggaggttcagga

SEQ ID NO: 4309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaccgcagagacacgccgaacgcgcctgt

SEQ ID NO: 4310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaccgcgtgtcagacaatcatgtcccctc

SEQ ID NO: 4311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaccttatccatgggtgcttgcgtgtctt

SEQ ID NO: 4312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacgaaacggctggtgacgcgctcctgac

SEQ ID NO: 4313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacgaactctacaattagcggctaccggt

SEQ ID NO: 4314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacgaccccgggcaggcggatcttgcttg

SEQ ID NO: 4315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacgatggacctgtctaacgcgtccggct

SEQ ID NO: 4316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacgtgtcgggtacagtattgctctgtct

SEQ ID NO: 4317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaactaggcttcctcatctgacatttatgt

SEQ ID NO: 4318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaactgctgcatttttggccatacgtggtg

SEQ ID NO: 4319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaactggccgtacgcatctggttgggagct

SEQ ID NO: 4320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaacttacctcgtagtcgaaactatgtttg

SEQ ID NO: 4321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagaaaggcagtagcggtaccgccgagag

SEQ ID NO: 4322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagacacttgctaaaggcttcgggggtca

SEQ ID NO: 4323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagacgcaaatgggtaaatgtcgctcgtg

SEQ ID NO: 4324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagaggtaccgctgttgcctggttactaa

SEQ ID NO: 4325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagatgttaaggtctttaatgatttactt

SEQ ID NO: 4326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagccgcggacacaccacgccctgtccac

SEQ ID NO: 4327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaggaatgcttgatagtccatcgatctcc

SEQ ID NO: 4328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaggagggaaatacaccgatctttatcgc

SEQ ID NO: 4329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaggccgccgtaaagatggacaggaaggg

SEQ ID NO: 4330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaaggcgcgtgcgaccgtctcagttctatg

SEQ ID NO: 4331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagggatgagttttctgcatttgatttgg

SEQ ID NO: 4332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagggtttggcgcatcatctagcagggtt

SEQ ID NO: 4333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagtctgattcgctgagaatacagcgttg

SEQ ID NO: 4334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagtgacgggggagctggggagtcctttc

SEQ ID NO: 4335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagtgcgtcaagctaagaatagctcaggg

SEQ ID NO: 4336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaagtttgttcgatattgaatccagagctc

SEQ ID NO: 4337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatagacctaaggtgcgaacgtgggaacg

SEQ ID NO: 4338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaataggcaagacgtcgcaatatactgtgg

SEQ ID NO: 4339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatagtggaccgctcgtgacatcgggaca

SEQ ID NO: 4340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatcacgccactgagttggcacactgata

SEQ ID NO: 4341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatcccgcaaaaccacgcggcaagtgtag

SEQ ID NO: 4342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatcgcgtcgtcgactactcgcgcaccca

SEQ ID NO: 4343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatgagaagtctctatctgttcggcagag

SEQ ID NO: 4344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatgattccgaccaatccgcctcttccaa

SEQ ID NO: 4345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatggccagttcagcttactcgaactgat

SEQ ID NO: 4346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatggggacacaaattttaactgggaaaa

SEQ ID NO: 4347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatgtctgaatgcgtaggactgacttcag

SEQ ID NO: 4348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatgtgaatagatcaagggtaccttgaat

SEQ ID NO: 4349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatgtttcgcactcctcgcccattgactt

SEQ ID NO: 4350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatttgccgcactacgagtctgctgatcc

SEQ ID NO: 4351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaatttggagaggttactaggctaccgcgc

SEQ ID NO: 4352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaattttcagtcccgatctgtggttgcacg

SEQ ID NO: 4353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaaaccgcgtatcttgacataggtgcgg

SEQ ID NO: 4354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaaagtggctaacgccttaatcatctgc

SEQ ID NO: 4355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaacacccagagactagtgagcggggca

SEQ ID NO: 4356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaactggctttgaaatggtccattgtcc

SEQ ID NO: 4357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaaggctggcatatgtgtaaggatgggt

SEQ ID NO: 4358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaatctgttcttcaatagttttgacccg

SEQ ID NO: 4359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacacaccagcgcgtttatttgagtcgatc

SEQ ID NO: 4360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacacagctcggtttgatcgtaagtgccct

SEQ ID NO: 4361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaccacgttgcatgctggcggggccaca

SEQ ID NO: 4362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaccacttggttccccttggcctcagcc

SEQ ID NO: 4363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacacggaagcggggtgtcgcatgacgggg

SEQ ID NO: 4364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacacggttcggtcagggattttcgatcgt

SEQ ID NO: 4365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacacgtaagtccactccgacagggtcagt

SEQ ID NO: 4366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacactttgcgtcactcgggaacgtcatac

SEQ ID NO: 4367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacacttttcgtattttcgatgcagaaata

SEQ ID NO: 4368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacagcacagcgtgggatcggtgcacgtgc

SEQ ID NO: 4369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacagcacagtcctgagaggtgttcggtcg

SEQ ID NO: 4370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacagctagcagccgggagtggcgcctcgg

SEQ ID NO: 4371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaggaaggattaactccacgtgtgcata

SEQ ID NO: 4372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacaggctgattaacacgcgccaagttctt

SEQ ID NO: 4373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacagtggcaggcgggaactagggggtcgg

SEQ ID NO: 4374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacataaagaagctgattgagcaagttggc

SEQ ID NO: 4375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacatacggccgtggtgtgaaggtgcaatg

SEQ ID NO: 4376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacatcgggcgttcaaagtgtctctatatg

SEQ ID NO: 4377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacatggttcaaaggggggttctaatcgtc

SEQ ID NO: 4378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacattaaattctgacgggggctggtctag

SEQ ID NO: 4379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccaaatgtgacaactagctcttgacagc

SEQ ID NO: 4380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccaagaatgcttagtgcgtagggacggt

SEQ ID NO: 4381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccaagatcaattttgcacgcaatgcacc

SEQ ID NO: 4382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccacttccgatttcctagttttctgtgt

SEQ ID NO: 4383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccagggcgcccaacgatgctcctcctcg

SEQ ID NO: 4384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccatagccacactctgtccgagcggtag

SEQ ID NO: 4385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccatctttttgtggcggagcgcaggaat

SEQ ID NO: 4386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacccggttaaagcgttgatcggtatgtgc

SEQ ID NO: 4387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacccgtcccggaagagatgttggtatcaa

SEQ ID NO: 4388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccgacaggctttcttcccgtaagagtgt

SEQ ID NO: 4389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccgacgaagcttggcaatcgagccgcgc

SEQ ID NO: 4390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccgagtgtgagtacatcctaaggtgcgg

SEQ ID NO: 4391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccgcagtcgatacgcgtcaggcagtcgg

SEQ ID NO: 4392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccggggcgaacgctgtgtgactggtgtt

SEQ ID NO: 4393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccggtgtcaggggccattcctgggtttc

SEQ ID NO: 4394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaccgtgtaccatcgtcaggtggtgttgag

SEQ ID NO: 4395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacctttaggtccaccgttaatcccccgtc

SEQ ID NO: 4396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgaaacaccctagcattcagggtgcgtg

SEQ ID NO: 4397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgacgacttcggccggagtgggtgccgg

SEQ ID NO: 4398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgaggctaatgatgaataacccttgctc

SEQ ID NO: 4399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgagtacacgctgcctcctgcatcctgg

SEQ ID NO: 4400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgatcgaggcattccgggtagcgaggcg

SEQ ID NO: 4401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgcacgtacatgtcctcctcgttgttgc

SEQ ID NO: 4402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgcagatggcgaactcttggcccatggg

SEQ ID NO: 4403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgccagcccgttcatcccggattgtgtg

SEQ ID NO: 4404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgccgacattcttatggcatgcaatggc

SEQ ID NO: 4405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgccggatacgccggtttaactcccctt

SEQ ID NO: 4406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgcctgggatcgacgtcgtctggtgtgg

SEQ ID NO: 4407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgcctgtcccttgttccacgtcctcacg

SEQ ID NO: 4408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgcgcgactcccctccaggtacatttca

SEQ ID NO: 4409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgctgcgttgtagtatggatcgacccgc

SEQ ID NO: 4410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacggaggaactcaatgtgcggtggaggga

SEQ ID NO: 4411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacggatgatttacacaagcccactccctg

SEQ ID NO: 4412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacggcttacctaatgctatatggaaatgt

SEQ ID NO: 4413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgggatcgaggggctcgtgccgttagtt

SEQ ID NO: 4414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacggggcttcatcggcgtaaaaagtcaac

SEQ ID NO: 4415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacggggtgcgttggttcacgatcactatc

SEQ ID NO: 4416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacggtaacgccaatgcacgtgcagctctc

SEQ ID NO: 4417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgtacgctggggattggcgcttctgttc

SEQ ID NO: 4418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgtagaaggttctaacgacccggccgta

SEQ ID NO: 4419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgtagggtgaccggcgaagtattgtccg

SEQ ID NO: 4420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgtgaatgggacggttcggaacgatgtc

SEQ ID NO: 4421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgtgctaatgaatttgtcaggcgcttgt

SEQ ID NO: 4422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgttaatgcgggaggaagcttgcctaag

SEQ ID NO: 4423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacgttgcgggcgggcgcggttttagttcg

SEQ ID NO: 4424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactaaccagctcgcgcttttacggtgtga

SEQ ID NO: 4425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactaggagacgagtgcgtggggcaaagga

SEQ ID NO: 4426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactatactattgatggccacatttctacg

SEQ ID NO: 4427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactatctaggcaattataaggtccgctca

SEQ ID NO: 4428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactatgggtgcgctgttcggcttcgggcg

SEQ ID NO: 4429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactattcgcagcggcgttctccaggttcc

SEQ ID NO: 4430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactcagcgaccactgaaggatggagttat

SEQ ID NO: 4431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactcagtacacctcgttggtacatgtttg

SEQ ID NO: 4432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactccatgcccggacagacggcgacacgt

SEQ ID NO: 4433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactcccccttgtgaacgtcaacgtatccg

SEQ ID NO: 4434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactcgacacgctatctttgggtcagtgat

SEQ ID NO: 4435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactcgatccgctgccggtacgccagagct

SEQ ID NO: 4436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactcgattgcgggcgggttttactacgag

SEQ ID NO: 4437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactcgggttgtcagggatttgcgagaccc

SEQ ID NO: 4438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactgaacagtcacttcaaactcgtcgaat

SEQ ID NO: 4439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactgacgtaggggacagaagctgtgcatc

SEQ ID NO: 4440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactgaggaacacgagaacagcttgttggc

SEQ ID NO: 4441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactgggggcataggcgttgagcgacgggt

SEQ ID NO: 4442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactggtcgctcaatgagtgacgccagggc

SEQ ID NO: 4443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgactgtcatccccgtcgatggccgctccgg

SEQ ID NO: 4444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacttacgcgattcacggctgttgctatgg

SEQ ID NO: 4445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacttatttcaaacgggacattcaggcgcc

SEQ ID NO: 4446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacttcgcctcaatgtaaccctgcccgtga

SEQ ID NO: 4447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacttgcccaacgagaacgttgttacgtgc

SEQ ID NO: 4448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgacttgtgcgcctctgagttctctccgact

SEQ ID NO: 4449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaaaattttatccagtgcgtcgcccaga

SEQ ID NO: 4450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaaattgcgtcgggtctagtcacgcacg

SEQ ID NO: 4451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaacagggtcacagggatgggtggcggg

SEQ ID NO: 4452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaagagaacggcggactagaccccgcgg

SEQ ID NO: 4453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaaggatcgattaggcgtgggttgggcc

SEQ ID NO: 4454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaaggcttggacgtggatcattatctat

SEQ ID NO: 4455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaatttcctgttcgtgggcacgctttgt

SEQ ID NO: 4456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagacaagaccagcttccatagcctgagtg

SEQ ID NO: 4457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagacaagggcagcggttttacagtctaat

SEQ ID NO: 4458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagacatgtcgttagctattctgttttgcg

SEQ ID NO: 4459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaccgtcgcattatgtgacctgcactcg

SEQ ID NO: 4460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagagagaacgcaaactggttggggatgtg

SEQ ID NO: 4461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagaggcgagatcgtccgtcatggtctctt

SEQ ID NO: 4462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagatgccgttcatatgtcatgcgagggac

SEQ ID NO: 4463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagatgtcggggcagttgttgataagagct

SEQ ID NO: 4464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagatttgcgaataggatgacaacgtctga

SEQ ID NO: 4465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcactgtctacttgagatgggcatccat

SEQ ID NO: 4466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcacttctctggcctggaagctggctct

SEQ ID NO: 4467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagccactcgcagaatagcaatagtgtcgc

SEQ ID NO: 4468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagccagtattccatcgcgctcaaggggtt

SEQ ID NO: 4469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcccaaactgatggtgccttggtccgct

SEQ ID NO: 4470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcccagtgaagatccatggtctgctagc

SEQ ID NO: 4471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagccctgtataccacggccccccctccgc

SEQ ID NO: 4472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagccgatggttttcatgcaggaggtgttg

SEQ ID NO: 4473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagccgcgctgaaagtcacttgatccgggt

SEQ ID NO: 4474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcctattgctgactgctgctctgtcaac

SEQ ID NO: 4475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagccttgtctttcggtccttaacctcgtg

SEQ ID NO: 4476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcgactatgcatgttgtgttattcgtac

SEQ ID NO: 4477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcgcaatggtcacttggcacccatattc

SEQ ID NO: 4478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcgcaggaggtcatcgaatatgtggggt

SEQ ID NO: 4479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcgcgtagtgactgctgtggggagcacc

SEQ ID NO: 4480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcggactctcgattgttgctgttgctgt

SEQ ID NO: 4481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcggctgaagttcagggcagttatggtc

SEQ ID NO: 4482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcggcttagataaccgcatgatctgagc

SEQ ID NO: 4483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcgggaggaggggaaactgtcgtgcgct

SEQ ID NO: 4484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcgggtgaaattgccttcctcccctgct

SEQ ID NO: 4485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagcggtctgaataggcagaggtgaggcgg

SEQ ID NO: 4486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctaatgcgcgtatgtgggggggggcaa

SEQ ID NO: 4487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctacccacctgtccccggagcagacct

SEQ ID NO: 4488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctcacggtcaccttggaatctgggcgg

SEQ ID NO: 4489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctcgactggttagtcagcccccgattt

SEQ ID NO: 4490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctcgcccataatgcgcggggtcgggta

SEQ ID NO: 4491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctcggtaacacgcggatctcagtcctg

SEQ ID NO: 4492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctctcattgctctaacgttcaggcacc

SEQ ID NO: 4493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctgaggcaggtctccttcgccgtatct

SEQ ID NO: 4494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctgcgcgttaatagctttctttaaagg

SEQ ID NO: 4495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagctggcacagcgggtgcgaggcaaatag

SEQ ID NO: 4496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggacaaggctgattgcgctcccttcggc

SEQ ID NO: 4497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggacatccaatcgtgggggtggggccgt

SEQ ID NO: 4498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggaggagcatcgggtcggcatcgagatg

SEQ ID NO: 4499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggagtgagtcacgcaagttgcggttggc

SEQ ID NO: 4500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggcaaggtccagggcacggttcagttgg

SEQ ID NO: 4501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggcactatggtgtgatcgttcaagactg

SEQ ID NO: 4502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggcccagttgtcgctagtgtaagcagtt

SEQ ID NO: 4503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggccgaacttaacaggacgggaggacgt

SEQ ID NO: 4504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggccgcagaacggatgggttttgggctc

SEQ ID NO: 4505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagggacggacaacacatgcttaaccggca

SEQ ID NO: 4506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagggactaacgcgcaagatacggggaagt

SEQ ID NO: 4507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagggagcggctagatacggatgacttggg

SEQ ID NO: 4508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagggatgcgctccagttcacggtgtagcg

SEQ ID NO: 4509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagggcgcagtcaggttgtccatgtcgtag

SEQ ID NO: 4510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagggctctgcaagcggaacctttgtttac

SEQ ID NO: 4511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggggcgacggattgataggctgcggtcg

SEQ ID NO: 4512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagggggtaaaacgttcgccaagcggttcc

SEQ ID NO: 4513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggtagcccaccgcagttgccagttttcg

SEQ ID NO: 4514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggtatcgactaaggggggcgaacggggc

SEQ ID NO: 4515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggtcgttggttacaaatcttgggtctgg

SEQ ID NO: 4516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggtgaatcggctgaaatgtaaataagag

SEQ ID NO: 4517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggtggccgacgggctagttgcgatggct

SEQ ID NO: 4518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggttggaccgggcggcggaatactcgtc

SEQ ID NO: 4519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgaggttgtttgaggtgggtcttcaaggcgc

SEQ ID NO: 4520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtaatatctttgctgtactaccagctat

SEQ ID NO: 4521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtacgccgcgataaagacaagatagcaa

SEQ ID NO: 4522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtagagtggcatcaagggatagagggcg

SEQ ID NO: 4523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtagcactcacaccggggtcagcctccc

SEQ ID NO: 4524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtagggccagttaggggcagcggtgagg

SEQ ID NO: 4525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtcagcaaaacaccggaacttgagagcg

SEQ ID NO: 4526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtcctgtaaggcgtgggccgttcgcggg

SEQ ID NO: 4527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtcgcatatgtttcgcatagcgtacctg

SEQ ID NO: 4528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtcggagcgggcggtagtgtgtggagtg

SEQ ID NO: 4529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtgatatcgcggaaagggcaggcgaaag

SEQ ID NO: 4530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtggggagtgttcgtgactgcgaagggc

SEQ ID NO: 4531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtgtcctctcccagagtgctatccttat

SEQ ID NO: 4532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagttaaggcaatgctagacgatcgcacgg

SEQ ID NO: 4533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagttcacacacagggggcggtgtttgacg

SEQ ID NO: 4534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagttcggcgataaggctatgcagttggcg

SEQ ID NO: 4535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagttgacctacccgtttcgtacggttcat

SEQ ID NO: 4536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtttagcccggtaatgtcgctcatgctt

SEQ ID NO: 4537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgagtttggaccgctttagacaccgaccggg

SEQ ID NO: 4538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataaacgggcgacaactcgctagatccac

SEQ ID NO: 4539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataaacgtgttggattgggtcttgtcggt

SEQ ID NO: 4540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataaatggttaaacggagctcgaccctct

SEQ ID NO: 4541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataaccatgccgcttcccttgcgttatgg

SEQ ID NO: 4542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataacgcgtacattcagcacatggtatcg

SEQ ID NO: 4543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataagccgaactccgccacatgtattcgc

SEQ ID NO: 4544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataattgctttactaaaaggtatcagggc

SEQ ID NO: 4545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatacccatgctcgataactgtttgcattc

SEQ ID NO: 4546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataccttttgtcccaacatccaaactccg

SEQ ID NO: 4547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatacggatgtcacctagatcaaccgggtt

SEQ ID NO: 4548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatacttacactgctatgcgggttgtgctt

SEQ ID NO: 4549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatagaagacgacgaaaccagcatatgaat

SEQ ID NO: 4550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatagacgcagcatcaaaggactagggccg

SEQ ID NO: 4551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatagcaacgcctgagcgacaatgctctgt

SEQ ID NO: 4552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatagccgccgcgggtatgattgacgggtg

SEQ ID NO: 4553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatagcgtgtcaacagaacgaacttttctt

SEQ ID NO: 4554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgataggacaggggacttaaggcgtacggac

SEQ ID NO: 4555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatatgatccaatcgacaggatcttatcta

SEQ ID NO: 4556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatatggttctcccgccagagtgatgcatt

SEQ ID NO: 4557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatattaccatgccggctaacttcactcct

SEQ ID NO: 4558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatattatgggttctgattgtatttgtcgg

SEQ ID NO: 4559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatattgaagttgcggtatttctacggtat

SEQ ID NO: 4560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatattgtgccacctgtgtccggagatgtc

SEQ ID NO: 4561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcaaatctagcacctcggtacgaataat

SEQ ID NO: 4562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcaatgtacgtcatgcaccacattgggt

SEQ ID NO: 4563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcacgctgtaggagggacgagctaaaga

SEQ ID NO: 4564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcactggacacattttcgagtgtattac

SEQ ID NO: 4565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcagctcacgtcctcttgttgcagactg

SEQ ID NO: 4566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcatcgttatggggaccactcataggcg

SEQ ID NO: 4567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcatgaaggaagtgacacctaactctcc

SEQ ID NO: 4568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcatgcgccgtgctacagcctttacgta

SEQ ID NO: 4569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatccccgggcattttaggccagcggtgag

SEQ ID NO: 4570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatccgagcctcttagcagatgtcacttcc

SEQ ID NO: 4571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatccgtcggacccattcagttgtctggta

SEQ ID NO: 4572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgaattaggccgtgggtttgcttaggg

SEQ ID NO: 4573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgacggcctaggaacgcgtggcacgga

SEQ ID NO: 4574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgagccttggcggaggatgctctcgag

SEQ ID NO: 4575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgagcgaggaagtacaaggtctttcct

SEQ ID NO: 4576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgaggtgcgatggaatcaatgcgacgt

SEQ ID NO: 4577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgatcgcctggggcctttcgacggagc

SEQ ID NO: 4578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgatgttattcgcccggttggtgactg

SEQ ID NO: 4579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgcgcctgcggtgggcaacaacgacgg

SEQ ID NO: 4580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgcgggacgaccgacgttgcagcgtgg

SEQ ID NO: 4581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcgctccacaggtgcagtatgatacgac

SEQ ID NO: 4582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcggtgtcaacgtacatatatggcgcac

SEQ ID NO: 4583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatctccgccgtgggtttaggcctggtcgg

SEQ ID NO: 4584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatctcgttgcctgtaagacctcagctcgg

SEQ ID NO: 4585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatctgcgtacgcaggcatcccattccccc

SEQ ID NO: 4586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatctggcatttgacctggtgttgcagctt

SEQ ID NO: 4587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatctgttaattccgctacactgctatcga

SEQ ID NO: 4588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatcttaatggatgaacatcgcgtggttca

SEQ ID NO: 4589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgactccccttactgtgacacactcaga

SEQ ID NO: 4590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgagatgtggtttattccatccctgggc

SEQ ID NO: 4591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgaggcggttccaattcggtgtgatcgt

SEQ ID NO: 4592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgatgtctcccacattgggtcgatttta

SEQ ID NO: 4593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgcaaatgagggttgggggttacttcgg

SEQ ID NO: 4594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgcgacagaagttgaatctcatttcacc

SEQ ID NO: 4595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgcgacgcaatcagagcagtagttatgc

SEQ ID NO: 4596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgcgacttgagagacccgctgggaatag

SEQ ID NO: 4597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgcgcacgtctgtagcggtgagtttgcc

SEQ ID NO: 4598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgcgccttccgcggctactggtactgag

SEQ ID NO: 4599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgcgtaatagcctgtgcaacatgggctt

SEQ ID NO: 4600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgctacggaacgatgctgtgcgcaggcg

SEQ ID NO: 4601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgctattctcaccccatctggcaccaat

SEQ ID NO: 4602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatggataacgattcttggcagggggcgtc

SEQ ID NO: 4603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatggataggtgtaagccatgatgtcaatt

SEQ ID NO: 4604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatggctcatactcctgtgttcagcagttc

SEQ ID NO: 4605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatggcttaagtgcaccactgcatgtcgag

SEQ ID NO: 4606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgggaaacagccgcggcatcttttactg

SEQ ID NO: 4607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatggggggcgttttgcgaggatcctggca

SEQ ID NO: 4608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgggtccacattaacttgcgttttctag

SEQ ID NO: 4609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgtgagtaaggcaaaattgttggcaact

SEQ ID NO: 4610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatgtgcctcaatgagatgttctccctggg

SEQ ID NO: 4611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattaggaccacgcatgcttcagatagact

SEQ ID NO: 4612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattataggctttttcgttgtgttgggcgg

SEQ ID NO: 4613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattatgatgtccgaccctggctgatctgg

SEQ ID NO: 4614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattccgtgctgcagtcaatgtcactgacg

SEQ ID NO: 4615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattctttcgccgtcttcattggacttaac

SEQ ID NO: 4616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattgactcttgccgctgagccatgtggca

SEQ ID NO: 4617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattgccctattcgatggcagcttggtgct

SEQ ID NO: 4618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattgggacatctccggtgttcaactggtt

SEQ ID NO: 4619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattgtctgcttcagtcactgagcgctaga

SEQ ID NO: 4620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattgtcttgcaaggttgaggtctgctctt

SEQ ID NO: 4621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattgtgcaagtgatgacaatgtagaaggt

SEQ ID NO: 4622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgattgtgggagacgctctcgtgacatcgat

SEQ ID NO: 4623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatttacgggtcatattttgtacttggatt

SEQ ID NO: 4624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgatttgcccttacgccagagtgcgataagc

SEQ ID NO: 4625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaaagagccctgaggtgtgtgcctggaaa

SEQ ID NO: 4626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaaagcaaagtaggtaaacccacgccaga

SEQ ID NO: 4627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaaaggtatcgtataggagcagttccggg

SEQ ID NO: 4628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaaagtagatgcgattgggcttcatcgcc

SEQ ID NO: 4629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaaatatgggcggtgttgggcgggatggc

SEQ ID NO: 4630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaaatttactctattgcgggtagacggtc

SEQ ID NO: 4631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaacgccacgtcaccgtcggaagaacgcc

SEQ ID NO: 4632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaacggcaataagtcgctggtcgaaaacc

SEQ ID NO: 4633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaacgtgtatctcggattgtcaatggact

SEQ ID NO: 4634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaagcaggtcccggcgtcgtgcgggcaac

SEQ ID NO: 4635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaagccacttcattctatggcgaaacttg

SEQ ID NO: 4636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaagcccaatctgtgtgagacagtatctc

SEQ ID NO: 4637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaaggcgctgttgtctgttccagcccacg

SEQ ID NO: 4638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaagggactcggtcaattacacgtgggga

SEQ ID NO: 4639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaatacaaatcgggcgatccgtgctttcg

SEQ ID NO: 4640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaatactatgaacttccatccgtctcctt

SEQ ID NO: 4641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaatctccgcagaatccgtccgggtatca

SEQ ID NO: 4642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaatgaaatgcacgagtatatgacttgcc

SEQ ID NO: 4643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaatgggaccgcttgtagagtaatggtat

SEQ ID NO: 4644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaattattcacagtatacttgtggagcga

SEQ ID NO: 4645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacaagacccttccattgtcgatcttgct

SEQ ID NO: 4646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacacaaccacaggaacagatcaagagtc

SEQ ID NO: 4647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacacccaagatgacgctcgagtccgtcg

SEQ ID NO: 4648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacagcctcggatccagggcagtcttccc

SEQ ID NO: 4649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacaggagtggatctggcaacccgaaatc

SEQ ID NO: 4650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacatacatcggggcacccctgcaacacg

SEQ ID NO: 4651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacatggggcgccaacgaacatgccagtt

SEQ ID NO: 4652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaccaccgtcgtcacatcaagccctcttg

SEQ ID NO: 4653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacccgtagactcagacctgagccaccga

SEQ ID NO: 4654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacctttactcgccatacggtggtagcta

SEQ ID NO: 4655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgaagtctgaggcttactactggctcg

SEQ ID NO: 4656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgagcagctgccgatggatttatcgtg

SEQ ID NO: 4657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgccctttgcactgtatgtgaaggtgt

SEQ ID NO: 4658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgcgcgacgccagcagcctctttgttg

SEQ ID NO: 4659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgctttatgtaaggcacccccgtacca

SEQ ID NO: 4660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacggctgcctcccccggattccacacga

SEQ ID NO: 4661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacggtctcatgccatccgcgtacactgg

SEQ ID NO: 4662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacggttcaaggtaagtcgtctgattatg

SEQ ID NO: 4663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgtagccgccggacatcaggttgactc

SEQ ID NO: 4664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgtctacattgcagtaccgactcaagg

SEQ ID NO: 4665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcacgtttgttaagcgggtacacgctgccg

SEQ ID NO: 4666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcactacggtatgacgaccgcatcaagttc

SEQ ID NO: 4667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcactccatggccggaacggaattcgggcg

SEQ ID NO: 4668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcactcccacaaccggactttacgacttcg

SEQ ID NO: 4669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcactctcatggttgaatgtgacttgtgac

SEQ ID NO: 4670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcactgggagcgcacacgggttatgtgttt

SEQ ID NO: 4671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagaacgctggtatgaaatgagcgtcccg

SEQ ID NO: 4672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagagagtctgtagccggagctgccggga

SEQ ID NO: 4673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagatcagttgctaaagtgggccagtact

SEQ ID NO: 4674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagcagtgaggtctcatacgtccacgcgc

SEQ ID NO: 4675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagcataaggggaggcatcaattggtcgg

SEQ ID NO: 4676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagccaccaaataggcgacaaggcagatg

SEQ ID NO: 4677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagccggatagtggaggctaaattgctcc

SEQ ID NO: 4678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagcgtagggcccttgtcgtggcttagtg

SEQ ID NO: 4679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagctcggtaataagaggttaaacttagg

SEQ ID NO: 4680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggacgaatctggggccactgcgctgga

SEQ ID NO: 4681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggattcgggaccgtggtaacagtcggt

SEQ ID NO: 4682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggcaccgtctttgagctggagaagcta

SEQ ID NO: 4683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggccaaggggaaagagaccgggagcgg

SEQ ID NO: 4684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggccaccctacaacattgcacgcgcgt

SEQ ID NO: 4685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggccgcgcaagcagatgttttgtcggt

SEQ ID NO: 4686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagggcctaccatccacgactgcgggtat

SEQ ID NO: 4687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggggacgtccagcaaaagtagccatac

SEQ ID NO: 4688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggtaaccggatcgaccacttagcgctg

SEQ ID NO: 4689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcaggtccattcttcgttagggtatcgcgg

SEQ ID NO: 4690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtacaacacgcaagtaagggctgcggg

SEQ ID NO: 4691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtacacgtaccttcagccaacatgcga

SEQ ID NO: 4692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtatctggcacttcgtgttccatcggg

SEQ ID NO: 4693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtattgacccattctgcataagacgag

SEQ ID NO: 4694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtgaatatctcgctttaggatcgctcg

SEQ ID NO: 4695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtgatttacgtatcgccggtcttcgtg

SEQ ID NO: 4696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtgtgtttgattacgctcgtcagtgtc

SEQ ID NO: 4697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagttgacgcttgcaattgtggtctcgcc

SEQ ID NO: 4698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtttcgggtgataactgaccccttcga

SEQ ID NO: 4699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcagtttggagaggtgccttttatggttcg

SEQ ID NO: 4700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatagagaaacggtgtgacggcggagcgc

SEQ ID NO: 4701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatagggggaggacagaatcggggtaact

SEQ ID NO: 4702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatatggcttcggctgacttggcaggggc

SEQ ID NO: 4703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatcaattcggcaagacatccgcttccga

SEQ ID NO: 4704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatcagagttggtatcattccggtgtcgg

SEQ ID NO: 4705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatcatgcccatggaactggctggccggc

SEQ ID NO: 4706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatcgaacgttcgggttgttcatccctgg

SEQ ID NO: 4707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatcgaatgcggttttaccttcttacggc

SEQ ID NO: 4708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatcggcaccaatgcaccaagttcaggtg

SEQ ID NO: 4709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatgctgggaacgtggtctaacttgcgcg

SEQ ID NO: 4710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatggtggcgccaccttcaagtttgtcac

SEQ ID NO: 4711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatggttatttttggtgtgtccattgctc

SEQ ID NO: 4712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcattacctttcgagatgtctaagcactgc

SEQ ID NO: 4713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcattacggtttcatgcatcgaattacaac

SEQ ID NO: 4714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcattatttggctttactacctttgacact

SEQ ID NO: 4715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcattcctgccttttcagtgaaggcgcagg

SEQ ID NO: 4716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcattctaccgggccagtgggttcgccgtc

SEQ ID NO: 4717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcattggataatggggctcggatgcctaac

SEQ ID NO: 4718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcatttggaatgtggccgaccccccagcgc

SEQ ID NO: 4719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaaaaccgctggtcgacctcgttcaaac

SEQ ID NO: 4720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaaaccactcggcaggcagggcttgtct

SEQ ID NO: 4721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaagaagacagcatgcgatcgtgtcaaa

SEQ ID NO: 4722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaagctgacccctcaggagagtagaggc

SEQ ID NO: 4723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaagttcagactagacacagaaggggtt

SEQ ID NO: 4724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaatcggaattctctagtactacctttc

SEQ ID NO: 4725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaattgggattacgaggccgcagaaggg

SEQ ID NO: 4726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaattggtctactgaaggagcatctttg

SEQ ID NO: 4727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccacacttcagccgtttcgacgcacggtt

SEQ ID NO: 4728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccacaggcccagttacgggcagcgaagtg

SEQ ID NO: 4729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccaccttgtacttcgccaaatcgtcctcc

SEQ ID NO: 4730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccacgaccgcgcacgcattcagaggtatg

SEQ ID NO: 4731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccagaatggagccacgcaacatgccgggg

SEQ ID NO: 4732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccagactaaccaaggggtcatatcccgtg

SEQ ID NO: 4733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccagccttatttgcaggccgtaagtctag

SEQ ID NO: 4734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccagctggtgcatcataagtctgataact

SEQ ID NO: 4735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccagggatcaggacgcaggttcagtaggc

SEQ ID NO: 4736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccagtaacgtaaggccagacactttttct

SEQ ID NO: 4737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccagtgtggaagttccggagttttgtcac

SEQ ID NO: 4738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccatcaaggttaaccctcattcgggtgtt

SEQ ID NO: 4739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccatgctcaacagcattatcagtctggga

SEQ ID NO: 4740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccattaacgcgcgggtgacctaactggcg

SEQ ID NO: 4741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccattgcgctttttgcacaaacgtgttcc

SEQ ID NO: 4742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccatttaaggttgtgttgcgagggtgtat

SEQ ID NO: 4743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccattttcccgtgcaaagaaaaattcgag

SEQ ID NO: 4744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccaaaggacgggcttctcgcacaacccg

SEQ ID NO: 4745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccaagccagggttatgtggtcctcgcgt

SEQ ID NO: 4746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccaaggcatgctattgctacacgtagca

SEQ ID NO: 4747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccacatgcgagtgccggctctggtgttt

SEQ ID NO: 4748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccacgacgagaggagagctcggctgatg

SEQ ID NO: 4749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccacgattggggtccccgagccgtttgt

SEQ ID NO: 4750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccactagtattattaggtccgcttcggg

SEQ ID NO: 4751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccagccttgaggagtctgacgagtctcg

SEQ ID NO: 4752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccaggattttgtttgtcacccggaaaaa

SEQ ID NO: 4753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccaggtaacgtgcgatgacacagacggg

SEQ ID NO: 4754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccaggtaaggtcagctcagcacgtgggg

SEQ ID NO: 4755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccagtttccctttcggaacgggatgcca

SEQ ID NO: 4756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccatactttctctgtgggatcaacccga

SEQ ID NO: 4757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccatcacctcgcctcgatccagcagcta

SEQ ID NO: 4758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccatttgaggagcgattgacttttgcgt

SEQ ID NO: 4759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccccaaatcgcgattagccgacattcacc

SEQ ID NO: 4760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccccccagcctgtacccaccgctgtagc

SEQ ID NO: 4761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccccggatccttagcatccaagcggtccg

SEQ ID NO: 4762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccccgtcttgccaactcaggtcgctcaca

SEQ ID NO: 4763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccctaatctgtagtccgtttgtcttgtg

SEQ ID NO: 4764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccctactcggtctaacttgtgaacccac

SEQ ID NO: 4765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccctgtgtatgccagtgagggggaatca

SEQ ID NO: 4766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccgaccgtggacgtggctgtcagaggtc

SEQ ID NO: 4767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccgccaatcggtcagtatcttttctctt

SEQ ID NO: 4768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccgcgctacaccgctactggcccccatg

SEQ ID NO: 4769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccggacgctatcctaggtttctctctcg

SEQ ID NO: 4770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccgtacccgatggggactatgctccatc

SEQ ID NO: 4771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccgtgtaatcatggtcttagttaagcgg

SEQ ID NO: 4772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccctactaaccaaggtgcgtgggcacggc

SEQ ID NO: 4773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccctcggttcccacggtcggttgacggcc

SEQ ID NO: 4774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccctgatcattcgagtaggaagcagctgc

SEQ ID NO: 4775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcccttaataggttccccctcgggcctgtt

SEQ ID NO: 4776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgaactttgatcactacattgcgctctg

SEQ ID NO: 4777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgacacataatttaaaacctaataccca

SEQ ID NO: 4778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgaccgaatggtacgcagttagacaagg

SEQ ID NO: 4779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgagacggataggcccaagtgtatatac

SEQ ID NO: 4780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgagcaggctgcaagtcttctcagctac

SEQ ID NO: 4781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgatcgggggacgttaaatcggttcggt

SEQ ID NO: 4782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgatgcgtttgtccctggctatctgcct

SEQ ID NO: 4783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgatgtcttgtttgtactgatggttcaa

SEQ ID NO: 4784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgccaagggtggcaactcgtgtcgccgt

SEQ ID NO: 4785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgcgcgacgtacgcatggttcgagaaat

SEQ ID NO: 4786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgctgttacctggcgcagtggccggacc

SEQ ID NO: 4787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggacctaacatttacactgcactggtt

SEQ ID NO: 4788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggcacactgcttctcgttgcattatgg

SEQ ID NO: 4789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggccagaaaggaatggcggaaaggatc

SEQ ID NO: 4790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggcccccttcaggcaacgtgactcgtc

SEQ ID NO: 4791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggccgacggatttggtcttctctccca

SEQ ID NO: 4792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggctgtggggatgtggagctgtattgt

SEQ ID NO: 4793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgggcgttgtaagctagcgaggtgcagt

SEQ ID NO: 4794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggggaaacgcgtcgtcttcctgtggct

SEQ ID NO: 4795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgggggtccgagcctgcacctacgtcgt

SEQ ID NO: 4796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggtagcacgcccgtcttctgtcgcttg

SEQ ID NO: 4797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccggtcacgttaggcccttttgtgggaca

SEQ ID NO: 4798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgtcaatttatattaggtgacaacgtgc

SEQ ID NO: 4799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgtcagcacgatttactggcggtctctg

SEQ ID NO: 4800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgtgaagctggaatccgttgcagacaca

SEQ ID NO: 4801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgtgcgagagacactcgtgttcatcatc

SEQ ID NO: 4802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccgtgtccagctgatctttgcagcgaggt

SEQ ID NO: 4803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctaaggttaccgccatgttggtacggtc

SEQ ID NO: 4804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctacactacttaaccattcactttggac

SEQ ID NO: 4805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctagcccttttgtgttgtttgccaatgc

SEQ ID NO: 4806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctagttgccattgagcaggctctggtat

SEQ ID NO: 4807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctatgggccatatgctgtgttactgcgc

SEQ ID NO: 4808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctattaatctcaagaggcatagcacccc

SEQ ID NO: 4809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctcacatttgctcaggttagaattcccc

SEQ ID NO: 4810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctccggagccatcaatagaacctttgtt

SEQ ID NO: 4811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctcgagattctcgtaagcccctcaccct

SEQ ID NO: 4812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctcgcggtcagctaccacgtcattccgg

SEQ ID NO: 4813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctctactggtagtcgacgttccatatgc

SEQ ID NO: 4814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctctatcgccatcaagtggtcgctgcta

SEQ ID NO: 4815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctgacactggacgcctatcccctggtcg

SEQ ID NO: 4816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctgatcgcatgctggcccatttttgtgt

SEQ ID NO: 4817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctgcacgtactggagctcacggacactg

SEQ ID NO: 4818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctgccgaagttttttattcacagcgctt

SEQ ID NO: 4819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctgcctgctatccgtctctcggtccaac

SEQ ID NO: 4820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctggcggagggtgcctccagtattctgc

SEQ ID NO: 4821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctggtacactctcgtggccttgtggaat

SEQ ID NO: 4822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcctggtctagtcctgggctaaatgatggc

SEQ ID NO: 4823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccttacgtgaccgttgggtaagcggcgac

SEQ ID NO: 4824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccttatcacacatggcttcgggtgaccgg

SEQ ID NO: 4825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccttgctcagactcgaccgcagttgataa

SEQ ID NO: 4826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgccttggggcaagtcaaactagttctatgt

SEQ ID NO: 4827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaaacgaaagtccctcccatgagtgatt

SEQ ID NO: 4828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaaagcccctaatgcgactgttggcgtt

SEQ ID NO: 4829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaacaattggcaaagcagctcaacgttg

SEQ ID NO: 4830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaacctcgacgcctgccaaacggggatt

SEQ ID NO: 4831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaagacaggcacagctcggagtcccgat

SEQ ID NO: 4832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaagaggcgacgctagaagtggcaactc

SEQ ID NO: 4833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaattaacggatttggtacgaagacttg

SEQ ID NO: 4834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgacgacacagagcaatgacctgtgggtt

SEQ ID NO: 4835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgacgccgtacgactcttgcctttcgcgc

SEQ ID NO: 4836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgacggtcgaaaaacgcttagcagtcagg

SEQ ID NO: 4837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgagaccgtacagtccccggtgcttgttg

SEQ ID NO: 4838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgagatgtgctgttgctgcttacgggtta

SEQ ID NO: 4839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgagcggatctccattgccacttgggtcg

SEQ ID NO: 4840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaggaggccggcgttggtacgtaccagt

SEQ ID NO: 4841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgaggcaccacatgtatggccaatatccg

SEQ ID NO: 4842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgagggcccctaaggacgcggttggaggc

SEQ ID NO: 4843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgagggctatcgctcaaactgtgggttgt

SEQ ID NO: 4844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgataacgtgcggaagaactggaagccgc

SEQ ID NO: 4845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgataccttacgtttccgcctcggggggc

SEQ ID NO: 4846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgatcatcatttcaacgaattgaatatgg

SEQ ID NO: 4847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgatcgccacactttgctcgcaccggttc

SEQ ID NO: 4848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgattcacggagtcgacaccgttcgtagc

SEQ ID NO: 4849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcaatacggtatggcggtcgatcctggg

SEQ ID NO: 4850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcaattgccgtcaccacgaaggacttac

SEQ ID NO: 4851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcaccagagactaccgatatcgtcacat

SEQ ID NO: 4852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcaccgtggtatttcagctgttcggccg

SEQ ID NO: 4853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcacgaataccaaggctcctgtcaatta

SEQ ID NO: 4854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcacttaccgccagcagtggctcttatc

SEQ ID NO: 4855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcacttattcataccatccatatcgaac

SEQ ID NO: 4856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcaggacaggttgaatgaatcactatca

SEQ ID NO: 4857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcaggccgtattgtctcgtgcaatgggg

SEQ ID NO: 4858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcagtcggcggcgagcttgcaaacacgc

SEQ ID NO: 4859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcatcatggacgaagtgacttattaaag

SEQ ID NO: 4860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcatgaatttatcttatctaagggcgag

SEQ ID NO: 4861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgccattcaccatctgggatgatagttgg

SEQ ID NO: 4862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcccgtgggtccaatgccatatcgtgcg

SEQ ID NO: 4863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgccgtgtctgcgaaactgagcggctctc

SEQ ID NO: 4864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgccgtttcgggtttcactcgtcttgacg

SEQ ID NO: 4865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcctattcgcatccgtgactgcctactc

SEQ ID NO: 4866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgaactgtggctcgtcaccatagctgc

SEQ ID NO: 4867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgaagttgaaggctctcgggctgggat

SEQ ID NO: 4868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgacggcataaacgtcctcttgaacgc

SEQ ID NO: 4869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgacttactctcaagccctcttgagtg

SEQ ID NO: 4870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgagaaatggtttgtatggataggacg

SEQ ID NO: 4871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgcactggtgtttatagctctgtgatc

SEQ ID NO: 4872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgccttcctaaaccgcacaaagtcggc

SEQ ID NO: 4873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgcctttcggttttcaagactacttcg

SEQ ID NO: 4874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgctgatccgtattgaagcttcgttcc

SEQ ID NO: 4875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcggagagcgagaggccagcgttggtac

SEQ ID NO: 4876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgggacttcaggttgacgtctgggtgt

SEQ ID NO: 4877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgggtccaagcactagccgtgatttga

SEQ ID NO: 4878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcgtagccattgtctcattccacccgta

SEQ ID NO: 4879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgctcatagcgattggtggtcacacttgc

SEQ ID NO: 4880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgctggggtggttttacgtcgggtatatc

SEQ ID NO: 4881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgcttttgtgttggccggctctgcacact

SEQ ID NO: 4882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggaacgtagcaatggatcggtaactcct

SEQ ID NO: 4883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggaactggaatgcgatcatgggtcgggg

SEQ ID NO: 4884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggacacaggcttgagcgcatagggatca

SEQ ID NO: 4885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggactcgtggttttgcattacagggcgt

SEQ ID NO: 4886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggactggcggaaagtcgggctgtgctgg

SEQ ID NO: 4887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggagacatgcccatgcgccaccatcggt

SEQ ID NO: 4888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggagggaaacacggcttagctggcggac

SEQ ID NO: 4889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggatcaaagggggagtagctgaatgcgg

SEQ ID NO: 4890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggatctgccagtctgagtcagtacactt

SEQ ID NO: 4891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggatgaccaagtgtcaatgtgggatgcg

SEQ ID NO: 4892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggattcacagaggtgtgggttcgtatct

SEQ ID NO: 4893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggcaatcaacgatgcctttcgggtgtta

SEQ ID NO: 4894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggcaatttggggccatgactctgtctga

SEQ ID NO: 4895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggcacacgtggtacctatcgggatgtgg

SEQ ID NO: 4896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggcagagcatcggctccttaggcatccg

SEQ ID NO: 4897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggcagtcaccagaaggaataaggcgtgt

SEQ ID NO: 4898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggccagcctccctcgtgcgcactggtgt

SEQ ID NO: 4899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggcgcgacagatcgagtcggaccgctct

SEQ ID NO: 4900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggcgtcaaaatcatccgtactcttccta

SEQ ID NO: 4901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggctaagaaaagtcgtgcgggagtctgt

SEQ ID NO: 4902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggctttgtcgtgctgtgggattagtcca

SEQ ID NO: 4903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggaagagcagggatccatggcgcaaca

SEQ ID NO: 4904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggaagggcacgaaccaggttgcctcac

SEQ ID NO: 4905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggaccaatacctcaaacgcgggcgatg

SEQ ID NO: 4906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggagagaaatgggattatgggcctcgg

SEQ ID NO: 4907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggagttcactaaacagcttttggctgt

SEQ ID NO: 4908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggatcggtttgggtcgttgggccccaa

SEQ ID NO: 4909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggatctcctctgacgatcacgcacatt

SEQ ID NO: 4910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggcacaccagtcgtcgaggtattggct

SEQ ID NO: 4911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggggaatcctggcgaggcggctatacgg

SEQ ID NO: 4912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggggaggcgacgacttaagatgatgttt

SEQ ID NO: 4913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggggaggtgaaccccagtaaccgtctct

SEQ ID NO: 4914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggggcacagagtcagatcgtcacggatg

SEQ ID NO: 4915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggggcagacagtccaagtacggagctgc

SEQ ID NO: 4916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggtcggtttcgctgttttagtcctttt

SEQ ID NO: 4917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgggtggtagcggcatggtctctgatgcg

SEQ ID NO: 4918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtccggcaaggcctcagttcatcactg

SEQ ID NO: 4919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtctggaactctacacggacatgcctc

SEQ ID NO: 4920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtcttctgatctgggtcccgggttgca

SEQ ID NO: 4921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtgattgggttggtgttgatcgccacc

SEQ ID NO: 4922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtgggctcgatacgaaaggctacatcc

SEQ ID NO: 4923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggttgaaatgttcgccgatatatcacgc

SEQ ID NO: 4924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtttcagtattcaccgaaagtcggtct

SEQ ID NO: 4925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtttgcggtatttccccctggtctccg

SEQ ID NO: 4926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtttggccctctactcgctaagggtct

SEQ ID NO: 4927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcggtttggctatctttcgcgtggacgtgg

SEQ ID NO: 4928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtacccgcagatctggccgtggctcggc

SEQ ID NO: 4929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtacggtagtactcatgagcttcaagag

SEQ ID NO: 4930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtagcggcatttccagcttacgttcgca

SEQ ID NO: 4931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtaggaccgggcaaacattgcacaacct

SEQ ID NO: 4932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtagtcgagtcaggccggggcgtgggtg

SEQ ID NO: 4933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtattggtcagttgctccgtcatttgct

SEQ ID NO: 4934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtcacccgctgcattgacctatctcgtt

SEQ ID NO: 4935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtcacgggcagaaccaacagagcaagcg

SEQ ID NO: 4936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtcactcgaatgtccacactttgtatac

SEQ ID NO: 4937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtcccgagtgatatagcgctaggtgcat

SEQ ID NO: 4938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtcgcatggtagagttcgctgccggggg

SEQ ID NO: 4939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtcttcctccactaagcacgtgagctcc

SEQ ID NO: 4940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtcttcggatcgtagtcgagataggacc

SEQ ID NO: 4941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgagtacatcgggtgtaagaaacagcg

SEQ ID NO: 4942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgatgagggaccaggatgttgccttgt

SEQ ID NO: 4943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgcattgctacttcacgccgcacttgg

SEQ ID NO: 4944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgccgaagattcgtagactgccgactt

SEQ ID NO: 4945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgcggttgaccgtggccgcgacgcggt

SEQ ID NO: 4946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgctgacatcgtctcggctccccggcg

SEQ ID NO: 4947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgcttatgagcgattagatcacggggt

SEQ ID NO: 4948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtggcagcgatttctcagtaatacgcgg

SEQ ID NO: 4949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtggtgagatgtggatctagcttagggc

SEQ ID NO: 4950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgtatttccgcatgaagacattcactt

SEQ ID NO: 4951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgtcagattgtagcgagcctcgtggca

SEQ ID NO: 4952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtgtgtgacctaattttctgctcggtgg

SEQ ID NO: 4953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgttaagcatcggtcatcgttccatgctc

SEQ ID NO: 4954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgttacgtaggtcccctggtcgcggaggg

SEQ ID NO: 4955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgttcacgccgtatccgccgacatttggt

SEQ ID NO: 4956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgttcgcaggtcactggtagagtcacggc

SEQ ID NO: 4957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgttctccacaaccactcggcacagcgta

SEQ ID NO: 4958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgttgcgcaatgtgcactactttcctgcg

SEQ ID NO: 4959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtttacatgccgcgcttgggcctgtctt

SEQ ID NO: 4960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcgtttgtggcttgtctattacttcagatg

SEQ ID NO: 4961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctaactatgggtattccctgtcggagtat

SEQ ID NO: 4962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctaactggccgggtggcgtaactcacact

SEQ ID NO: 4963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctacccatgaattgtgcggctctggggac

SEQ ID NO: 4964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctacccattacggtttgtcagggagagat

SEQ ID NO: 4965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctacgaggacccgttctaccgccccctct

SEQ ID NO: 4966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctacgggttccaaggttggctaggcgttt

SEQ ID NO: 4967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctacggtcgagaagggcccttaacctggc

SEQ ID NO: 4968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctactgtatatagactgttcgggttaggc

SEQ ID NO: 4969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctagagcactcgggtcaacacttgtggcc

SEQ ID NO: 4970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctaggacacttttgcatcaatctgggtcg

SEQ ID NO: 4971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctaggtgtacgcagcgtatgttgatgacg

SEQ ID NO: 4972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctatattagaccgtacttccattgcagac

SEQ ID NO: 4973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctatcaggcacgcatccggttctggttgg

SEQ ID NO: 4974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctatcctgccaggttaccttgtttgggtg

SEQ ID NO: 4975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctatcctgcttgcgacaagggtgcaaaat

SEQ ID NO: 4976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctatgccgggtaccataagcggtggccgt

SEQ ID NO: 4977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctatggcgagaggtcatcccacagccgtc

SEQ ID NO: 4978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctatgtgtatcggtggtgcatgcgggttg

SEQ ID NO: 4979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctattcggacgggtcttctgatatgtgtg

SEQ ID NO: 4980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctattcggagacccggtaggtatacacgc

SEQ ID NO: 4981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctattctggactgtaaagagagcggagcg

SEQ ID NO: 4982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcacaagttgaccgggaaggcgaaggcg

SEQ ID NO: 4983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcacatcacggaaccgtaggaggctcat

SEQ ID NO: 4984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcacgatcgcccacccacagtctccgtc

SEQ ID NO: 4985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcacggtcgagacatcgtggtaggactg

SEQ ID NO: 4986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcagccggttgcctcgggatactgcgat

SEQ ID NO: 4987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcatggccgtatctcagcttggtcctat

SEQ ID NO: 4988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctccatgaatccgcggggatgtgaagcct

SEQ ID NO: 4989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctccatgcaacgggttagcgatcatgttg

SEQ ID NO: 4990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctccatttacgtggctgattgctgataag

SEQ ID NO: 4991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcccaacggcacgtatctgtagccctcg

SEQ ID NO: 4992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcccagaatattgcctggttcagaccaa

SEQ ID NO: 4993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcccgagcacgatcacggattaaattgt

SEQ ID NO: 4994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcccgtggtcatctcttctgtagcccgc

SEQ ID NO: 4995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctccgcccctcggtgtagtcatctgatag

SEQ ID NO: 4996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcctcagaagacaggcctccggtggtaa

SEQ ID NO: 4997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcgaagcgtgcatgggtgattgttggga

SEQ ID NO: 4998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcgacatgcctattggtgcgatgtaagg

SEQ ID NO: 4999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcgagtgcgttgattggtgtgcatcgcg

SEQ ID NO: 5000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcgctggttccccctcttgtttctagtg

SEQ ID NO: 5001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctcgttagccacgtgtcatcctgtgaagc

SEQ ID NO: 5002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctctaagggggtgttgcagtgcaagtcgg

SEQ ID NO: 5003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctctccgccgacaggatagtcattgatta

SEQ ID NO: 5004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgaaattgctgtgtaaaacggtacgccg

SEQ ID NO: 5005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgaactttcggaacgctggccgggtggg

SEQ ID NO: 5006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgaagggccaggaccattgtagcttgcc

SEQ ID NO: 5007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgagataccacgttgcatcattagtgtt

SEQ ID NO: 5008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgagtaatgtgcgccacatgcgatagac

SEQ ID NO: 5009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgatatggttatttagggattaatacct

SEQ ID NO: 5010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgatcctgtattctggcacatactcgag

SEQ ID NO: 5011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgcaaagaccgggcagctggcaaccgaa

SEQ ID NO: 5012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgccaatgtgctaacaaagtgctctcgg

SEQ ID NO: 5013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgccacaagcactgagaaagaggttcga

SEQ ID NO: 5014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgcccagcaaccgccgcactcggttggt

SEQ ID NO: 5015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgcggatcagttagtgaccgacagtacg

SEQ ID NO: 5016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctggagtgttatgatggacttgccggatc

SEQ ID NO: 5017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctggattcgacttggatgtgacgtttgaa

SEQ ID NO: 5018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctggctaccacttatcctcgtccactggg

SEQ ID NO: 5019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctggctttgaatttaacaacggggtgggg

SEQ ID NO: 5020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgggggtcgctcagtgcctgagaagtgg

SEQ ID NO: 5021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctggggtggtgaactcgaggtgtaggtta

SEQ ID NO: 5022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctggtgacccttccgctaatcggcctatc

SEQ ID NO: 5023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctggtgtatcgcgcagggatgttcttagt

SEQ ID NO: 5024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtaactttgcatgggtacggcatcgct

SEQ ID NO: 5025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtaagcctttcgggtggctggtggtgg

SEQ ID NO: 5026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtattgaacgacgccctgcaactagca

SEQ ID NO: 5027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtcaggactcaagttgagttggcgggc

SEQ ID NO: 5028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtccgacacgaacgggggaaccacacc

SEQ ID NO: 5029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtgctattcaatacttttacgatttac

SEQ ID NO: 5030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtgggtggtgtgttatactagacacta

SEQ ID NO: 5031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgttgaaggtgtgtgacctcttacaccg

SEQ ID NO: 5032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctgtttaggcctggtcacggccgttgttg

SEQ ID NO: 5033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttaaaacgtcaagtcagtgttattgatc

SEQ ID NO: 5034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttaccacagaggcaagttataggaggta

SEQ ID NO: 5035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttatgccgagctcattgttgatgcccac

SEQ ID NO: 5036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttcaatgcctgtggcacgctcacttgtt

SEQ ID NO: 5037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttcacttgcacctcgccttgtacgcgcc

SEQ ID NO: 5038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttcctttgccccagacggttctccctca

SEQ ID NO: 5039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttcggttattgaatcacgctggttctgt

SEQ ID NO: 5040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttcgtcgcgcgttgcaaataattttctc

SEQ ID NO: 5041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttctacctcgaagtgcacttcaagcgcg

SEQ ID NO: 5042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttgcattatgtacggtggtgaatcctac

SEQ ID NO: 5043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttgcgtgggtcactgtgcggtttacaat

SEQ ID NO: 5044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttggtaatggaagtgacgcgtcccgtga

SEQ ID NO: 5045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttgtggcatcagcggcagtgtttggctg

SEQ ID NO: 5046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttgtgtcgagattgagtcgggagcacct

SEQ ID NO: 5047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttgttagcaatgagtacccgtctccgtc

SEQ ID NO: 5048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctttacaggatcaggcggctcgatatcga

SEQ ID NO: 5049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctttaggtatttgcacctcttcgctacac

SEQ ID NO: 5050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctttattggtcgatattgcgaagaaacgg

SEQ ID NO: 5051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctttctcccgactgatcatcttagagtga

SEQ ID NO: 5052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgctttgggatcatcgggagctaggaggttt

SEQ ID NO: 5053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgcttttttattcgataactacagtcaagtg

SEQ ID NO: 5054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaaaaaaggttgaggccgcgccttgtgg

SEQ ID NO: 5055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaagagacgcgttaacagttcaatcgaa

SEQ ID NO: 5056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaagcgtcccctccgcataccgattcct

SEQ ID NO: 5057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaagcttgtctttgcggtgcgcgtctac

SEQ ID NO: 5058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaatgcagttacgatgtagctatgcggg

SEQ ID NO: 5059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaccaagccaggggaaagtgaatcggtc

SEQ ID NO: 5060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaacgctctcgatgccgcgggacgggtct

SEQ ID NO: 5061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaactactcggttgttttactggtttcct

SEQ ID NO: 5062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaacttcatttcttttcacaaggaccagg

SEQ ID NO: 5063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaagacgtgcgctagcgacttttcagcta

SEQ ID NO: 5064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaagagcttgcgggttgtggtcagacgtc

SEQ ID NO: 5065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaagccaggggtctaaggagtttgtttcg

SEQ ID NO: 5066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaggaaaaataagacccccagcatgatc

SEQ ID NO: 5067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaggcgcagtgagtgtgtgagtttggcc

SEQ ID NO: 5068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaagggacatatctcgttttatgggctag

SEQ ID NO: 5069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaaggtgatttggaagtcagtcattggta

SEQ ID NO: 5070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaagttagagcttcgtgattttacgcatg

SEQ ID NO: 5071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaatagcattattggtagctatagaatcg

SEQ ID NO: 5072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaatcaacggtgccctacacggaccctgt

SEQ ID NO: 5073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaatcaatgtaaatactataaagcgaaag

SEQ ID NO: 5074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaatgatccggtgctggctcatctggcca

SEQ ID NO: 5075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaatttgcggtatggcacacacctggttt

SEQ ID NO: 5076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacaattgagcgggacgctcggaccaggt

SEQ ID NO: 5077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacaccacgtgaagaggcctttgggtgtc

SEQ ID NO: 5078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacagcgcttggacggtggaacggagtta

SEQ ID NO: 5079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacattcacaggcgtttgtgaccgaatgt

SEQ ID NO: 5080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacattgcaattggcttaacggcgctcct

SEQ ID NO: 5081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacccagcggaggacgagtggccgggcgc

SEQ ID NO: 5082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacccgaagtacatcactccccgttgctc

SEQ ID NO: 5083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacctgtggtacttgttgatcgtcctgct

SEQ ID NO: 5084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgatcactgagaacccaatgcgactgc

SEQ ID NO: 5085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgcaggttattggcttagggtctgtcg

SEQ ID NO: 5086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgcatctttctgtatggttggcgcgct

SEQ ID NO: 5087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgcggcgattactccccacaattgggc

SEQ ID NO: 5088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacggagcttcgtggcagtggtgtggcgt

SEQ ID NO: 5089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacggctcgttcggtaggagctagcaggt

SEQ ID NO: 5090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgtaatattaagtttcgcacaagcttc

SEQ ID NO: 5091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgtaattggtgttgggtgatttagtcg

SEQ ID NO: 5092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgtgttggccccctcttcacctcaact

SEQ ID NO: 5093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacgtgttgtgtcctgatagcggcctcgg

SEQ ID NO: 5094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggactacaagttcatgtccgctatgcacga

SEQ ID NO: 5095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggactactcctctgctggtcgctgttaacg

SEQ ID NO: 5096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggactagcgcactccttgtgcatgtgtgaa

SEQ ID NO: 5097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggactcgtagcaacctatgtccaagcgccg

SEQ ID NO: 5098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggactctgtgtccctcgttctcatgcctcc

SEQ ID NO: 5099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggacttgtgaatctggacggggagtaagcc

SEQ ID NO: 5100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagaacgaccccggcttgagtcaaaatcg

SEQ ID NO: 5101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagaatttgacacgaacgaggcatctctt

SEQ ID NO: 5102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagacagtcagatgatctcagctggtggc

SEQ ID NO: 5103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagaccgttatgtctggcgggggctggtc

SEQ ID NO: 5104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagacctgcggggctgaatacctgatatt

SEQ ID NO: 5105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagagtggattgcggggctacgacggacc

SEQ ID NO: 5106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagagtttttcgcaccccgggtaagcacg

SEQ ID NO: 5107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagatagggtcatcggtgttccttcatat

SEQ ID NO: 5108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagatggtcagtatgctctcgtataggat

SEQ ID NO: 5109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagcagatgagtcatgacaggtaccgctg

SEQ ID NO: 5110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagcagctgatcgcatcggcacaaccggg

SEQ ID NO: 5111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagcatgccagcggggaggaaggaactcg

SEQ ID NO: 5112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagccggccccccatgaaccgttctgccc

SEQ ID NO: 5113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagcgagccacgtgtgtctcattggcgcg

SEQ ID NO: 5114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagcgttgtaagatatttggggaatttga

SEQ ID NO: 5115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaggaagcgggtctcataaaatgtgtttc

SEQ ID NO: 5116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaggcagggtggtccgggtgccagacggc

SEQ ID NO: 5117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaggccgggctgtaggaaacccttccctt

SEQ ID NO: 5118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagggctgccggctcgcggacacgcgctc

SEQ ID NO: 5119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaggggactccatcgtactcactgccctc

SEQ ID NO: 5120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggaggtcgcagggcaaaatcccggggcggg

SEQ ID NO: 5121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagtaaagtatgaatcgttgcctcccacc

SEQ ID NO: 5122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagtaccggagtcgtacgttggtgctagg

SEQ ID NO: 5123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagtagtgcatagatagcgtcactagcac

SEQ ID NO: 5124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggagtgtcatgctaccatggctattgatgc

SEQ ID NO: 5125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggataaaaaaggggttattaaatgatttcg

SEQ ID NO: 5126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggataaacccatcaatcgccgtgtccgtca

SEQ ID NO: 5127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatagctaaagaccggggctccgtatggg

SEQ ID NO: 5128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggataggtcggtctacgcgacgaggagccg

SEQ ID NO: 5129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatatatacatcgcaagactaattgtcgt

SEQ ID NO: 5130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatcagcggggtcaaaacagcatcgcagt

SEQ ID NO: 5131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatcagtcactaagggcttgctgtttggt

SEQ ID NO: 5132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatccatattggagacgctggttattgat

SEQ ID NO: 5133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatccatgctctcttaaggttacctccgg

SEQ ID NO: 5134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatccgctcagtctgccgatgggccgaga

SEQ ID NO: 5135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatccggtcgcagagcgttggattagccg

SEQ ID NO: 5136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatcgagatgtggcattgttgtcctccat

SEQ ID NO: 5137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatcgcactaccaggttgtgccatttccc

SEQ ID NO: 5138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatcgtacgagcattgccgaatgtcgagc

SEQ ID NO: 5139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatcttcctttgtttcattctcagcccgt

SEQ ID NO: 5140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgagcagtgggacaacgtgtggtgggc

SEQ ID NO: 5141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgagtatagaaattgttatattcagtt

SEQ ID NO: 5142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgatagcgcggccaactcacaacgctg

SEQ ID NO: 5143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgcaccgaccgaaccagtacccggtgg

SEQ ID NO: 5144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgcggcatcgtctggaaatcacgcgta

SEQ ID NO: 5145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgctggtgttgggttagcacactctcg

SEQ ID NO: 5146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatggtctgtggcgttccataagaggtgc

SEQ ID NO: 5147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatggtgagggtgaggaagtggtggcgac

SEQ ID NO: 5148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgtcagatggtcacggaacgcttgaat

SEQ ID NO: 5149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggatgttcgctcgctacgtgacatttgctg

SEQ ID NO: 5150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggattaacgcgatccaggggcgggcgtgtg

SEQ ID NO: 5151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggattcagttccgtcgataccaccgtgttt

SEQ ID NO: 5152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggattcgccagactctgtgccgcatagctt

SEQ ID NO: 5153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaaataagggcggcttcggtgttccatc

SEQ ID NO: 5154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaacacacaacgtttctagacccaagtc

SEQ ID NO: 5155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaacacgcgatatgatgaagcatgaggg

SEQ ID NO: 5156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaaccgtatgcgcgcttcaatgagacca

SEQ ID NO: 5157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaacgcgatatcagccgggcgaaggttg

SEQ ID NO: 5158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaagctagcggctggagttattgtagac

SEQ ID NO: 5159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaagctcgcaacatttatgcattgggtg

SEQ ID NO: 5160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaagtttactcttagggtaactttgcac

SEQ ID NO: 5161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaataacgaggtccgacctccgccggca

SEQ ID NO: 5162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaatgcgttggtatgccatcgatctttt

SEQ ID NO: 5163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaatggagtagacgtgtgcatccctggg

SEQ ID NO: 5164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacaatcgcggctcaggctacttggtgt

SEQ ID NO: 5165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacatgtataccatagttcctgcgggtc

SEQ ID NO: 5166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacatttagggctcccgtacgccttgct

SEQ ID NO: 5167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaccggataggttggctgaaacgtggtg

SEQ ID NO: 5168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacgaacgattggtctctggtgtcacat

SEQ ID NO: 5169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacggccccgtaaaggcccgaaacctca

SEQ ID NO: 5170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacgggcgggaggctgtacatgagggtg

SEQ ID NO: 5171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacggtatttcatggccctcatatcggt

SEQ ID NO: 5172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcacgtatctattcccactggtggcacgt

SEQ ID NO: 5173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagagatcaagtgccctaggctacatgg

SEQ ID NO: 5174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagccgggacaacaactagtgcgtttaa

SEQ ID NO: 5175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagccggttggttttgtcgggcatcacc

SEQ ID NO: 5176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagcctggtagcgaagcggcgtcagtgc

SEQ ID NO: 5177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagcgtcgcagaggccggctccaccaac

SEQ ID NO: 5178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaggactacgtgttcttagctgacgatg

SEQ ID NO: 5179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagggctacgaccggcatctccaatgga

SEQ ID NO: 5180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcaggtccaggcacttcgacagtgatggg

SEQ ID NO: 5181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagtaacttccggtgttgtcatcgtttt

SEQ ID NO: 5182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagtacagtgcaacacttactgattcgg

SEQ ID NO: 5183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcagtcacggtgactgtcgaccggcattt

SEQ ID NO: 5184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcataaatagtgttctcatgtatattcat

SEQ ID NO: 5185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcataggggtcggtgccgtttggaaggaa

SEQ ID NO: 5186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatagtctcctcaggtcccacgccaacc

SEQ ID NO: 5187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatctggatttgcctaaataatcgtggt

SEQ ID NO: 5188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatgagaggcaggcggtgtgccttagat

SEQ ID NO: 5189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatgcacgagatgataaacccagttcta

SEQ ID NO: 5190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatgtagaaataatttgagcagtctgct

SEQ ID NO: 5191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatttagtgctgcttacgcttggacctt

SEQ ID NO: 5192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatttcggccgagctcgccttttggtcg

SEQ ID NO: 5193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcatttttggacgacactgtgtactcggc

SEQ ID NO: 5194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccaacacgctcagggttatttgaaaatg

SEQ ID NO: 5195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccaattggagagtactggtgtcatggat

SEQ ID NO: 5196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccacaggtccttatacgtgccacgagcg

SEQ ID NO: 5197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccatagagggcttgacgcaacgacagcg

SEQ ID NO: 5198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccataggattttgagtgtcaggcggatg

SEQ ID NO: 5199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcccacaatacagcgtgaaaaacgtgttg

SEQ ID NO: 5200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccccagagataattaatgttcctgtttg

SEQ ID NO: 5201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccccccgtacgcttggttctttttgtac

SEQ ID NO: 5202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccccctatgttctcagagggttgcgact

SEQ ID NO: 5203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccccgggcgtgattatcctccgaccatg

SEQ ID NO: 5204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccccgggtatggatttgaaagcaagagt

SEQ ID NO: 5205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcccgaagccagcaagtggctgcatcgag

SEQ ID NO: 5206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcccggaccatctcttctattaatgcgtt

SEQ ID NO: 5207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcccggcgaagcgttttcctgcattcgaa

SEQ ID NO: 5208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcccggcgactcctggcgtacgcgaggtg

SEQ ID NO: 5209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccctaatactatggcgtggctgcctttg

SEQ ID NO: 5210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgaggcaatactctcatggccttaagc

SEQ ID NO: 5211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgcagggtattcatgtccgctgtgtcg

SEQ ID NO: 5212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgccattgctgatacgggttacgtgcc

SEQ ID NO: 5213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgcgcgactggatcggaagcatatgcg

SEQ ID NO: 5214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccggcagtcagggacccatatacttcgg

SEQ ID NO: 5215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccggctaggaagccaatgcgtcatcgtc

SEQ ID NO: 5216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccggtcaatgtcgttagctcagtcctga

SEQ ID NO: 5217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgtaatccaagcccccttcattcaggt

SEQ ID NO: 5218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgtagtcgccgatgcggggccggatag

SEQ ID NO: 5219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgtgtatgtgagcggatggtccgatac

SEQ ID NO: 5220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggccgttccgtggttttgcagacattttga

SEQ ID NO: 5221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcctcagatgttcacgactccggtgacga

SEQ ID NO: 5222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcctccggggaaagatgatcgactgcgag

SEQ ID NO: 5223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcctcgacgtttccagtgctacgatacga

SEQ ID NO: 5224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcctcgcctgcttccgattgggcaacgct

SEQ ID NO: 5225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcctggatttgccttccgcttaggtgtgg

SEQ ID NO: 5226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcctttggggagggagatctcggccgccg

SEQ ID NO: 5227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgaactcaccctcatctctggacctgct

SEQ ID NO: 5228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgacatgatccctcctacgcaatgacgc

SEQ ID NO: 5229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgactgaacacaggcgagataccagtcg

SEQ ID NO: 5230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgaggaccgaaaccgtctgcatggttct

SEQ ID NO: 5231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgatccactaatttgcagcgtgcttgca

SEQ ID NO: 5232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgatctcattctcctgacgccacgggcg

SEQ ID NO: 5233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgatggataatgggcgtaccattcacga

SEQ ID NO: 5234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgattcgaaacaacggcgcctaggttaa

SEQ ID NO: 5235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcagtgttttgactcgtcgaacatccg

SEQ ID NO: 5236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcatgacggtaggcgtgtgagtgcggg

SEQ ID NO: 5237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcccctggccagtgtcgttcgccgcgg

SEQ ID NO: 5238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgccctacgagagcaaaccggtggcagt

SEQ ID NO: 5239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcgcaaaccggaagcactggtgcacgg

SEQ ID NO: 5240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcgcgcagcaggtggagggcgagtggg

SEQ ID NO: 5241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcgtcgcgtgtagaagtaatacgttgt

SEQ ID NO: 5242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcgtgtcggtcattacgctgtcactcg

SEQ ID NO: 5243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgcgttgccagtgaccggaccaacgggg

SEQ ID NO: 5244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgctggtttgggcctggtccttcggcgt

SEQ ID NO: 5245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggaaatttacggtttcagtcttgcaca

SEQ ID NO: 5246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggaattccatatcctcgcgggtttagc

SEQ ID NO: 5247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggacgtagcatacacaatgcgattcgc

SEQ ID NO: 5248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggagggacgcgccaggcaggatcggcg

SEQ ID NO: 5249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggcagcagaacatctagaggcttggac

SEQ ID NO: 5250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggcaggctgggtgttggggggcacctg

SEQ ID NO: 5251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggccatcccggagcttggttttcgcga

SEQ ID NO: 5252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggcgctatcatgggtcgatcggctgag

SEQ ID NO: 5253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggcgctgtcgctttcctcggggtcgtc

SEQ ID NO: 5254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggcggtgctatggtttccctctcggcg

SEQ ID NO: 5255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggctaatgcacgtgcaccagccaggcg

SEQ ID NO: 5256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggctggaatgcgcatggactgacgact

SEQ ID NO: 5257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgggcaaacgtgtgcgaaacccctgagg

SEQ ID NO: 5258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgggcgtccaactcgcgggggctggcgc

SEQ ID NO: 5259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgggctttggtactaccagatgacaact

SEQ ID NO: 5260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgggtcctgctgatttacgtcagactaa

SEQ ID NO: 5261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcggtttggagtgcggcgctctgataatg

SEQ ID NO: 5262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgtaactccactcgcatgttatgtgcac

SEQ ID NO: 5263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgtatatttttgcaatctacgggggagt

SEQ ID NO: 5264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgtcaggctggcttgggtttctcgaggg

SEQ ID NO: 5265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgtgactcgaagcattcgacgttgtaca

SEQ ID NO: 5266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgtggtttttgcgtcatcggggtgggcg

SEQ ID NO: 5267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgttcctacttagctgtgtcaggcggcc

SEQ ID NO: 5268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgttgagcaagttcttgtggatgctgct

SEQ ID NO: 5269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcgtttaagtggttccccccgacttcgtt

SEQ ID NO: 5270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctaacaaccgactgtcaatggcgcctta

SEQ ID NO: 5271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctaactcgacccgtgactttagcatctg

SEQ ID NO: 5272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctaagattgggactacacgtggcgaacg

SEQ ID NO: 5273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctacagatagcgatctacgattgattct

SEQ ID NO: 5274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctagaaaggctttggcttgggcgtgcgt

SEQ ID NO: 5275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctagaaggggcgatttcctgtttaggat

SEQ ID NO: 5276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctagactcgactaaggtttggcacttcg

SEQ ID NO: 5277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctagctcctcgctctccttgcttgttgg

SEQ ID NO: 5278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctaggtggaagtagtggcctccctcgtc

SEQ ID NO: 5279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctatcttcgatatatggccattccgcct

SEQ ID NO: 5280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctatgagtggaggtgacaagtggttggt

SEQ ID NO: 5281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctatgggaccgaagtaacctattccgtc

SEQ ID NO: 5282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctcaatgtacatggagtggatatcccga

SEQ ID NO: 5283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctcagcgctcaatcttagggcctgccaa

SEQ ID NO: 5284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctcagtcccgggcgggtgttcttgggtg

SEQ ID NO: 5285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctcgactcagtgcgggtaagctcaaggt

SEQ ID NO: 5286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctcgctaacatgattccaccgtatcgct

SEQ ID NO: 5287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctctactaaaataggtgcagctgttagt

SEQ ID NO: 5288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctgcaccacgaacttaccatgccccgcc

SEQ ID NO: 5289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctgcagagtggtctccgatttcgccaat

SEQ ID NO: 5290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctggtggctccctgtctggtacatcatt

SEQ ID NO: 5291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctggtgttaagtactcgatgccacctcc

SEQ ID NO: 5292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctgtggcaacatgtccagcttcgccttt

SEQ ID NO: 5293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctgttcaggagaccattgagtcagtgtt

SEQ ID NO: 5294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttagcccatattccacggaggtgctat

SEQ ID NO: 5295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttagtcggtcgtgttcatcggctcttt

SEQ ID NO: 5296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttataacggctacagtggacgtcatgt

SEQ ID NO: 5297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttatattgccagggcccattctcgttg

SEQ ID NO: 5298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttattctgttagggggttaccgcgcta

SEQ ID NO: 5299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttgatgctcgaggtgcggcagtgcgac

SEQ ID NO: 5300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttgcttgctcttggaggaaactcctgc

SEQ ID NO: 5301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctttatgcctgggtccttttgcccttcg

SEQ ID NO: 5302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctttcatcatttgttaatatgaggtaca

SEQ ID NO: 5303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctttctaatctcagtacatttgtgcctc

SEQ ID NO: 5304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggcttttacgcatgactgtcgggaggttgc

SEQ ID NO: 5305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggctttttcagctcttgtggggtgtgtgtg

SEQ ID NO: 5306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaaagcggccacagtaaattatgtaaga

SEQ ID NO: 5307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaaatggtgtgagtgcggtattccgggg

SEQ ID NO: 5308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaacgtcagtgtcactgaggtagacgac

SEQ ID NO: 5309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaactcgtgcaagttacatttaatgacc

SEQ ID NO: 5310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaataggaggctgctgatggaaggcgca

SEQ ID NO: 5311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggacagccgcccatacgatgttttaggct

SEQ ID NO: 5312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggacaggcaaacttcttagttgtgcgaca

SEQ ID NO: 5313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaccgttatgggtcactagaagcgttcc

SEQ ID NO: 5314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggacgcgctcataagaatcatcatgcgtg

SEQ ID NO: 5315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggacgcgtggtaagcattcgtttctggtt

SEQ ID NO: 5316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggacggcgaggcggttctgttatcaggtt

SEQ ID NO: 5317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggacgggacgagatcgccgttgtttatac

SEQ ID NO: 5318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggactagccgattcagcctgagccacgtc

SEQ ID NO: 5319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggactaggcagtcagctttggctctaccg

SEQ ID NO: 5320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggacttgcttttgtgtttcctggtcatcg

SEQ ID NO: 5321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagaaacgcatatggatcgaaatgcccc

SEQ ID NO: 5322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagaccaacttgttccgtcaatcgagcg

SEQ ID NO: 5323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagacccttgtgggataagataccgaag

SEQ ID NO: 5324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagactgtctgggttctcaatctggtac

SEQ ID NO: 5325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagatgcatttcgtggaacgggcgtaat

SEQ ID NO: 5326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagcccgcattgaagagtcactaccgat

SEQ ID NO: 5327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagcggttagtttatgcgttccgcctac

SEQ ID NO: 5328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaggaccatcgggtgtcgacgatgtata

SEQ ID NO: 5329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggaggcagtggtcggcgtatcgtacggtg

SEQ ID NO: 5330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagggtaaggagcaaaagtggaggcatc

SEQ ID NO: 5331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagtcgcggatggctcgttgctggtctg

SEQ ID NO: 5332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggagttgtccagattaaccctgggagtgg

SEQ ID NO: 5333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggatatgatagttgtccgcggcaatcctt

SEQ ID NO: 5334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggatcaaagccgggttgtataaaggagtt

SEQ ID NO: 5335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggatcggccgcctttaggtcgcatcggtc

SEQ ID NO: 5336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggatgctcataattgtccaacgtgctcaa

SEQ ID NO: 5337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggatgctgtcaatagggttaccgcctact

SEQ ID NO: 5338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggatgggaggcggcgtgcttttcgggatc

SEQ ID NO: 5339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggattcttcgtttcagtggtgaggacctc

SEQ ID NO: 5340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaaagggagacgcgggtttgttggggc

SEQ ID NO: 5341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaaagtccattggagacagcggtcgtc

SEQ ID NO: 5342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaaccaacacaagggactcggcctcca

SEQ ID NO: 5343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaacgtctaggactggccagcaccggg

SEQ ID NO: 5344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaagtcgcaaatgcttacgtcagtcca

SEQ ID NO: 5345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaatcttgttttccgaatagacttttg

SEQ ID NO: 5346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaatgggcgttcggcgatcttccaagg

SEQ ID NO: 5347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcaattctccgacgacgacgcatacgcc

SEQ ID NO: 5348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcacgggatacaccttgtcctgattggc

SEQ ID NO: 5349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcagctggtcaaagtcccgacgttctcg

SEQ ID NO: 5350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcagtcttgcgggtctttaaattcgaaa

SEQ ID NO: 5351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcagttttccttgagatctgggcatgtg

SEQ ID NO: 5352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcataatcgcctgtgtaccacacatgcc

SEQ ID NO: 5353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcatgtgtgggtggacgttacgaaacgg

SEQ ID NO: 5354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcattgtctaagtcagccttctgtaagg

SEQ ID NO: 5355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccaagaattactttattttgtttgtct

SEQ ID NO: 5356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccaatggacgatcgggtaaagaaggcc

SEQ ID NO: 5357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccatcacagattgagtcgatttagcgt

SEQ ID NO: 5358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcccaaacccccgtgcgaacacgtatgc

SEQ ID NO: 5359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcccagcgccacctttatcctctgacgg

SEQ ID NO: 5360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccccccgctaagcgttttttactttgg

SEQ ID NO: 5361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccgattgacttaagttcggtaaagggc

SEQ ID NO: 5362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccgccatggagcctttaccaccgctac

SEQ ID NO: 5363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccggatgcgaatttttgtcactagtcc

SEQ ID NO: 5364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccgggcataaccaggcggccatacacg

SEQ ID NO: 5365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggccgggggttgatgggggatggcaggtg

SEQ ID NO: 5366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcctgtatgcaaccttagattagtggaa

SEQ ID NO: 5367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcgcacggggagtctccgatcgtgccgc

SEQ ID NO: 5368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcgcagcgcgacggtatattcggtggga

SEQ ID NO: 5369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcgcattgggggattaacgggttggctg

SEQ ID NO: 5370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcgcggtttggcaacggcaaagtaaatc

SEQ ID NO: 5371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcgctaaactggactgccgggaatgcgg

SEQ ID NO: 5372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcggtcgcaccgacgtggatttactagg

SEQ ID NO: 5373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcggtcgctaagacggggatagccagcg

SEQ ID NO: 5374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcggtgtgttaagacgttttatcagtta

SEQ ID NO: 5375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctaattgatccgagtaaatgggacgta

SEQ ID NO: 5376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctagctcaggatagggcgtattttggg

SEQ ID NO: 5377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctcaacgggcgtgatagtctgtgtcgg

SEQ ID NO: 5378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctcagatcgcaggtttgtggaagcgtg

SEQ ID NO: 5379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctctcgtgcatcctttcggtacaccgt

SEQ ID NO: 5380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctgcctcaccaagatacggtaccgcgg

SEQ ID NO: 5381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctgcggttcattgggagctgagaaggc

SEQ ID NO: 5382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctgtacttgatcccgcgttcgaggtgc

SEQ ID NO: 5383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctgtaggtggcgacggctctttgccac

SEQ ID NO: 5384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctgtgcgactctgttactcctgcgcac

SEQ ID NO: 5385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcttaatatagcttctagtcatggcaaa

SEQ ID NO: 5386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcttctgcgcctctgtgcaccagtctac

SEQ ID NO: 5387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcttgcgaaaccctgccgcttctacgca

SEQ ID NO: 5388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggctttgcatcacaactactcttccgctc

SEQ ID NO: 5389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggcttttgcatggttctgcgggggctctt

SEQ ID NO: 5390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggaacggaaacgggtagtcgcgtgaaag

SEQ ID NO: 5391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggacgccgcgatcatcatttctcggtgg

SEQ ID NO: 5392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggacgggctctggcccgagtgcagttcg

SEQ ID NO: 5393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggagtaccatgtgccatacagctggtcg

SEQ ID NO: 5394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcaacagagatcagtatggatcgcaca

SEQ ID NO: 5395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcacgcaaggcaatgtccgtccgccgc

SEQ ID NO: 5396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcagcagttgtctgggccataccctat

SEQ ID NO: 5397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcatctagctgcgttgaggtttttcct

SEQ ID NO: 5398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggccaacgattccgggcttgatccgccg

SEQ ID NO: 5399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggccagcgttagagacgatatgtgcgta

SEQ ID NO: 5400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggccggtcgagtgctcctacacttgtcg

SEQ ID NO: 5401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcctcgtagcctatcattggttgtacg

SEQ ID NO: 5402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcgatgatcactacgcgctgcctcgtt

SEQ ID NO: 5403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcgttacggaatttggattggctcatg

SEQ ID NO: 5404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcgttgcagggtcgtcgtgatcgtggc

SEQ ID NO: 5405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggctccgagcaactcgcacgttaccggg

SEQ ID NO: 5406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcttaatgacttttaaagtggtgatac

SEQ ID NO: 5407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggcttttggggccgggccatttttagcg

SEQ ID NO: 5408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggggagtgaaaatcgactcgcgaattacg

SEQ ID NO: 5409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggggatatgtatgtgcgtgttcaggcggc

SEQ ID NO: 5410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggggcaccaatctatctaagcgtgttctg

SEQ ID NO: 5411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggggcggaaaatttgcagtcgcaagcctt

SEQ ID NO: 5412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggggcggtcgatggggttcgaagggacct

SEQ ID NO: 5413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggggacgttgacaacttacttcgtcttc

SEQ ID NO: 5414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggggggttagggaggtcctgcgctcgcca

SEQ ID NO: 5415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggggtggcgaatgctcatgctcggttat

SEQ ID NO: 5416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggggtgtcatcgggcatgggttggtcta

SEQ ID NO: 5417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggggttgttccagcttgagatgcagggtc

SEQ ID NO: 5418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggtatgggtctgaagtgtcccctgagga

SEQ ID NO: 5419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggtccacgcctgcatcggtcgacagtgg

SEQ ID NO: 5420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggtcgggcttctatcacataggtaacac

SEQ ID NO: 5421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggtgcatccagtccagttgtagtatctc

SEQ ID NO: 5422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggtgctgtttgacggtatgaggtatctt

SEQ ID NO: 5423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggtgtattgcatgtcgttatgcgatggt

SEQ ID NO: 5424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggggttcacagccctggcgacaatcatgcc

SEQ ID NO: 5425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtaaagccctggggagacgcgtaatatc

SEQ ID NO: 5426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtaacctgtgtagtcattgaggtcgacg

SEQ ID NO: 5427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtaatgctaaatccctctctggcctatt

SEQ ID NO: 5428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtacacgtggtggcctgccgtagaacat

SEQ ID NO: 5429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtactgcatagcaatggccaccgcgagc

SEQ ID NO: 5430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtaggaacatatcgctcacaccggagac

SEQ ID NO: 5431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtaggggtcctaagggttagggaagcgc

SEQ ID NO: 5432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtataagttccgtggcgcttgtgcggtg

SEQ ID NO: 5433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtatttctatagattggtaacagattca

SEQ ID NO: 5434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtcacacccacgtttatacgtttgccgg

SEQ ID NO: 5435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtcaggaactaactataacccattttgg

SEQ ID NO: 5436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtcgattattcgagggtcctcgtctcgc

SEQ ID NO: 5437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtcgccagtactatgccactgtcgggac

SEQ ID NO: 5438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtcgcgtctactgggtcacgtagtcaag

SEQ ID NO: 5439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtcggggaggcacaatttcttgtgcagc

SEQ ID NO: 5440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtcttctgatccattaccgtttgactga

SEQ ID NO: 5441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtgacctccaacatagggatggccctgg

SEQ ID NO: 5442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtgacgagtttgagggtgatccctatca

SEQ ID NO: 5443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtgcagttgataccaagttaggttcttc

SEQ ID NO: 5444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtgccaggtgcaaaccagatgagtggcc

SEQ ID NO: 5445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtggagcactggttgaacgcctcatgca

SEQ ID NO: 5446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtggaggcccaccacggaggtgtatacg

SEQ ID NO: 5447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtggatctggcgtcgggtatccaagagg

SEQ ID NO: 5448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtggcgggcctattccactggctttagg

SEQ ID NO: 5449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtgggatgcgtgaaatggggttaatggt

SEQ ID NO: 5450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtggggatgcatgcggttcaaaattggc

SEQ ID NO: 5451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtgtcacgctaaaaggagtcacgcgtac

SEQ ID NO: 5452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggttatgatgttactcgcgggtccctctc

SEQ ID NO: 5453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggttcggctcggcgccatttctcactcct

SEQ ID NO: 5454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggttctagcggcggggcaagacaacgctg

SEQ ID NO: 5455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggttctgaatgagatacaatttttaatgt

SEQ ID NO: 5456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggttgaaccttcctgcgtaccggatgctt

SEQ ID NO: 5457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggttgagccggtcatctcccctcgcggat

SEQ ID NO: 5458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgggtttccgacttacaagtgtcgccgtgtt

SEQ ID NO: 5459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtaacaaagcagttggtgttgtggtttgt

SEQ ID NO: 5460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtaacttcggggtcaactctgcctgaccg

SEQ ID NO: 5461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtaagatagtcgttatgtgtatgcctgtc

SEQ ID NO: 5462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtacagaatgctaaattgggcccagctga

SEQ ID NO: 5463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtacagcgcctgcagaaatatcagctttg

SEQ ID NO: 5464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtacgataggtgtggcttattatgggtgc

SEQ ID NO: 5465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtactccagtctgcttttatgcccgggga

SEQ ID NO: 5466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagacctaggcgtggtttgtggtccggc

SEQ ID NO: 5467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagagggggatccattgcttgctgttac

SEQ ID NO: 5468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagcataaccgattcaccagctgcccgg

SEQ ID NO: 5469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagccactggcgtgcgtgtggatatggt

SEQ ID NO: 5470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagcctagtctaggaccaattccatcat

SEQ ID NO: 5471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagcgactcccagccgagtcatacacgg

SEQ ID NO: 5472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagcggtcacgacatcgaatttcgtgtc

SEQ ID NO: 5473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtaggatcaattaggactcagcgtgacgg

SEQ ID NO: 5474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtaggcgacgggacagagggacgtgtaat

SEQ ID NO: 5475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagtaggtgctcaaacgtaagacaactc

SEQ ID NO: 5476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtagtcgtcacagttggcgcatgacttgg

SEQ ID NO: 5477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtataatccctcgacaaagatcggccctt

SEQ ID NO: 5478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtatagaacgactgacagacatcatctgt

SEQ ID NO: 5479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtatatcttggcggatatgaggacggggg

SEQ ID NO: 5480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtatctggccgcacgctgtgacagtcagg

SEQ ID NO: 5481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtatgcacatgttcttcgacggcgagcgt

SEQ ID NO: 5482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtattaggtgcttgggtcgtcgggggtag

SEQ ID NO: 5483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcacctgatcgtgataaggtcaggagtc

SEQ ID NO: 5484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcactgggctccgaaaataccataagtg

SEQ ID NO: 5485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcacttgcgcggaaatggcaataggggc

SEQ ID NO: 5486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcaggggtgtgaaagtgcagcgtccgcg

SEQ ID NO: 5487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcatttcttcctaacgttcggtccgccg

SEQ ID NO: 5488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtccaagaaaagttggaggttctaaaggg

SEQ ID NO: 5489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtccgcatcgttggccactggcaattggg

SEQ ID NO: 5490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtccggtccgctttgctgaaatgatgctc

SEQ ID NO: 5491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtccgtgaaggtgatcagtaggttcattc

SEQ ID NO: 5492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcctgctgtgtgaatcgacggggatgct

SEQ ID NO: 5493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtccttacttctgggacaatattctacaa

SEQ ID NO: 5494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgaagctagaggtggtagtacttgtcc

SEQ ID NO: 5495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgagccggagtaggaatgtgtgcggac

SEQ ID NO: 5496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgaggatcaagccggttttacgttatc

SEQ ID NO: 5497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgatatctctgtaatgtatggggccgg

SEQ ID NO: 5498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgatgagacgtgttcctcaggggtggc

SEQ ID NO: 5499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgcatgctgattaggatctccgagttg

SEQ ID NO: 5500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgcggaactcgcgatcaagccgtctta

SEQ ID NO: 5501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgctgtgtccaaatagttgcggggtgc

SEQ ID NO: 5502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcgggggtttatcggcgtcgaatcgccc

SEQ ID NO: 5503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtctagagcttcactggtctctggtttca

SEQ ID NO: 5504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtctcgaaaactgtcggcctcgtacccta

SEQ ID NO: 5505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtctcggggccatgctgttatatgtgctg

SEQ ID NO: 5506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtctgcgtgcgataaggctcggaagggat

SEQ ID NO: 5507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtctgctcgcgagttttaacttaggaccc

SEQ ID NO: 5508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtcttgcgtgatgatctgattcctgttca

SEQ ID NO: 5509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgaagcgttgctcttaaatcctcaacgg

SEQ ID NO: 5510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgaatacgggcaagacgggcggaaccac

SEQ ID NO: 5511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgacacgttcaacaccttggtacattac

SEQ ID NO: 5512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgagagcgcggcacccaaaaggaatttc

SEQ ID NO: 5513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgagtgattgcactaagcgcgggcgagc

SEQ ID NO: 5514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgatgggtgggagagcgttgttgtcagg

SEQ ID NO: 5515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcaggccagtgcatcggcataagcttg

SEQ ID NO: 5516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcagtgctccccgcaaggtaggcgtcc

SEQ ID NO: 5517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcattcatatccctgtactcggtttcg

SEQ ID NO: 5518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgccaacctgggtgcatgctctggacct

SEQ ID NO: 5519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcgatcccgggttggactgtttacttg

SEQ ID NO: 5520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcgcagggctgtacagtgcgttgggtg

SEQ ID NO: 5521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcgcgtaatcgctgacagctttgccac

SEQ ID NO: 5522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcggcgttagtgggaattgtgctacgt

SEQ ID NO: 5523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgcgtggcttcgtgcgaggcagatatgg

SEQ ID NO: 5524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgctagggtatgctgagttgcttagatg

SEQ ID NO: 5525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggacgcttaacgggctatttataaggt

SEQ ID NO: 5526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggatcatggactcacctgtagcgctac

SEQ ID NO: 5527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggcatgcgagggcggagctgtacagac

SEQ ID NO: 5528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggcgatgctttaggctagtcattagcg

SEQ ID NO: 5529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgggagccccttactttcgttcaagtgc

SEQ ID NO: 5530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgggggcacttggacccctcctcgatga

SEQ ID NO: 5531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgggtacacctcacaaccgagttactag

SEQ ID NO: 5532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggtattgcgtaacaaagtctattttcc

SEQ ID NO: 5533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggtccccgctggttaaagcagggtcgc

SEQ ID NO: 5534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggtggagtagttagtcggccgtctgag

SEQ ID NO: 5535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggtggcccgcttaggcggttatgcact

SEQ ID NO: 5536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggttcgagttccatgtagccttctgct

SEQ ID NO: 5537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtggttgggcgttcaaggtggcgatggat

SEQ ID NO: 5538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgtacgcctccaggtgcgcagacgcgta

SEQ ID NO: 5539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgtacgcttcgtcacgtacgcagccacg

SEQ ID NO: 5540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgtcaacatggtactgtaacagcgtatc

SEQ ID NO: 5541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgtggaactcctgccccgagacaggcct

SEQ ID NO: 5542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgtgggctttttgcgatgggagatcatg

SEQ ID NO: 5543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgttctctagtcttccggatttacctct

SEQ ID NO: 5544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgttggatggcccatcggcggtgtagcg

SEQ ID NO: 5545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtgttgtactgatggcgggcgtacggttc

SEQ ID NO: 5546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttaataggtggaccgctttgggtgtacg

SEQ ID NO: 5547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttaccgtcacttcagtgcatgggccttg

SEQ ID NO: 5548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttacgcggaggcgccgtgcatcccgtga

SEQ ID NO: 5549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttacttcgggtcttgcggatactgctac

SEQ ID NO: 5550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttagtggctattgggtacccggttgcat

SEQ ID NO: 5551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttatccgatgatctgcggaaggcaagcg

SEQ ID NO: 5552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttcaggtttctgtgcagtcggattaata

SEQ ID NO: 5553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttctccctcaagtggtttcggcgagagt

SEQ ID NO: 5554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttgaaagtagacgccaatcgcattcggg

SEQ ID NO: 5555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttgcctgcttataacgtatctcgttgtt

SEQ ID NO: 5556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttgcgctgaccactccatgattgcatcg

SEQ ID NO: 5557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttgcggggcagttacgttggatggtttt

SEQ ID NO: 5558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttgctggtggtcttccgtacttgtccgc

SEQ ID NO: 5559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttggacccccatcttcagggcgagcggg

SEQ ID NO: 5560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttgggaggttggggaagactagatagta

SEQ ID NO: 5561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttggttatatacgaatgccacgactaag

SEQ ID NO: 5562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttgtgcactctgcccttagtgtttcggt

SEQ ID NO: 5563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtttaccagccaaggcgatgcatctagtg

SEQ ID NO: 5564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtttatcataacacacgccgagttcgttc

SEQ ID NO: 5565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtttcctgctttgctttatttcgcgcccg

SEQ ID NO: 5566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtttgagcaatgaggcgagtggtgctgtg

SEQ ID NO: 5567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtttgctgatccggcagcctcttgctctc

SEQ ID NO: 5568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtttggttaccacgtgtacgctgattgcg

SEQ ID NO: 5569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggtttgtccttcgctctatacgattggtcg

SEQ ID NO: 5570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acggttttcaaggggtggtatatctggcattc

SEQ ID NO: 5571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaaacatcggtcttgggaggttgggctac

SEQ ID NO: 5572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaaagtctcgttctccatggacacaagta

SEQ ID NO: 5573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaaatgcaaaggggctaagaaagccaact

SEQ ID NO: 5574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaaccatccggaaccaccttacgttttgt

SEQ ID NO: 5575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaacgagatatatttttggagtgaccgca

SEQ ID NO: 5576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaacgcccctagtgaaaccgtgacatcga

SEQ ID NO: 5577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaactgacgctgagtgtttttggagccta

SEQ ID NO: 5578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaactgactggcccttaagtacttcgatt

SEQ ID NO: 5579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaactgattcttcaaatatccatgtccgt

SEQ ID NO: 5580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaagcccccagagatgatcaggacttttc

SEQ ID NO: 5581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaaggacaaccaattgtcggactcgtttg

SEQ ID NO: 5582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaaggtgtgtttccttgttgaatacaccg

SEQ ID NO: 5583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaagtgccatccgtgtcaagggtgaatgt

SEQ ID NO: 5584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaatcgtatcccgcgattcatgtgagatg

SEQ ID NO: 5585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaatgtgatcctgttcccatatgaccagt

SEQ ID NO: 5586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaattcggcggatcccgtaaggtcgcgtc

SEQ ID NO: 5587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacagacagccgcatatccactctggcca

SEQ ID NO: 5588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacagcccaagcgccgaacatcattacgc

SEQ ID NO: 5589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacatccggctctaatatcaaaactgcgc

SEQ ID NO: 5590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaccctccccgatttcatagtgacatagt

SEQ ID NO: 5591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacctcccagcgcgcttatggtttggctc

SEQ ID NO: 5592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacctgcctagtagtaagacgtgactgcc

SEQ ID NO: 5593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaccttgctatatgaacatctaaggtgtg

SEQ ID NO: 5594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaccttgtaggaatttattgtgggcttcg

SEQ ID NO: 5595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgaaattgcggagtcttatatgttttg

SEQ ID NO: 5596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgacccgctgaacttcggcgcgctgtg

SEQ ID NO: 5597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgaggagccaggcaatgtgccatagcg

SEQ ID NO: 5598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgccccacaagccacaggggaaatgtc

SEQ ID NO: 5599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgcctcggattcgaccattgcagcgta

SEQ ID NO: 5600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgcgattcaggaacgtggcaactgaaa

SEQ ID NO: 5601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgctattatcgcaaagtcattttacga

SEQ ID NO: 5602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacgggcatgtagaccggaggtcgtggtc

SEQ ID NO: 5603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacggggtacaagtatttgctgcgttgtc

SEQ ID NO: 5604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacggtgtaagagttggttcccgagtgtc

SEQ ID NO: 5605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtactagcatcaccgcaacaacggacgaat

SEQ ID NO: 5606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtactcatcggtagccggttgaccctcccc

SEQ ID NO: 5607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtactccgacacaagacccgaatgccgagc

SEQ ID NO: 5608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtactccggtacaaaacgccaaacgtggcc

SEQ ID NO: 5609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtactcctggtttatgtgccggcctttgta

SEQ ID NO: 5610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtactggttatttcatagttgatcccgatt

SEQ ID NO: 5611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacttacgcagattacttttcctccttgg

SEQ ID NO: 5612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtacttatcgcgtcatcgggtggccgccgt

SEQ ID NO: 5613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtactttctcggtaaaacgtctgagtcctg

SEQ ID NO: 5614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagacgcttcagatttgtatcgaggcact

SEQ ID NO: 5615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagacggcagccgcacgggacttaacggt

SEQ ID NO: 5616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagcacactgcaagcgctaaccgccctgg

SEQ ID NO: 5617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagcgccatgagcctacggggggtccatc

SEQ ID NO: 5618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagcggggcgtctgccgagttcgtggtag

SEQ ID NO: 5619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagctgccggttccataggattatgggtt

SEQ ID NO: 5620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaggattaaaatcctctgacacggtttcg

SEQ ID NO: 5621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtaggtcaaactcgacttccctccaaacta

SEQ ID NO: 5622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagttcatagtcggtggattgcagagaag

SEQ ID NO: 5623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtagttcgtatacgcatggccgcgaggacc

SEQ ID NO: 5624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatagccgccgctttcaatgtaaccgcgc

SEQ ID NO: 5625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatatttcctcttccaaggatgcgcgtac

SEQ ID NO: 5626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatcatgatctgcgtcgtatctcacgggg

SEQ ID NO: 5627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatccagagctgcgacgccgttaatgctt

SEQ ID NO: 5628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatcggccgaggatatttttccattcggc

SEQ ID NO: 5629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatctctttgaggggggtctcgtcaaagg

SEQ ID NO: 5630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatgctatccctcgtttagcgcttgatcg

SEQ ID NO: 5631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtatggcgaccgtgttaacatcggtgcatc

SEQ ID NO: 5632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtattaaagtctatcttggccattggatct

SEQ ID NO: 5633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtattttgccgcagagcgttgggacgaccg

SEQ ID NO: 5634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaaaggtcgcgccaggtatctgatagtt

SEQ ID NO: 5635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaacgctcttggattcctgttgttttaa

SEQ ID NO: 5636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaactcccaaggtacggttgtccgcggg

SEQ ID NO: 5637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaagatggatcctgaagtgtgtttccca

SEQ ID NO: 5638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaaggcaatggagtgatacatttgcgtc

SEQ ID NO: 5639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaagggtccaccggccggttttcaccgg

SEQ ID NO: 5640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcacatacaccctcgttgcaactgcgatt

SEQ ID NO: 5641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcacctctttcaatgtccaagccggcatc

SEQ ID NO: 5642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcacgatgcaattaggtcatgctgtggtc

SEQ ID NO: 5643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcacggggagcgtgctcttgcggtctggt

SEQ ID NO: 5644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcactacgcgcgagccctggtatagagct

SEQ ID NO: 5645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcagcactggatggtgcggccgctttgtc

SEQ ID NO: 5646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcagcgacccaggagtgtgccgtgggtgc

SEQ ID NO: 5647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcagctgcgtcggacatagatgccggaca

SEQ ID NO: 5648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaggctatagtgtgccacactccccgtc

SEQ ID NO: 5649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcaggggagcgcggtagtggctacgaggc

SEQ ID NO: 5650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcagtcagtacgcccttgagttatctgta

SEQ ID NO: 5651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcatcccttgcagcgattgtctgtaatcg

SEQ ID NO: 5652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcatgcccattcgcgtccttggatcactg

SEQ ID NO: 5653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccacatgatacccacataagctacatat

SEQ ID NO: 5654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccacctttatacctcggtccggatttcc

SEQ ID NO: 5655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccacggcagtagtcctcgggggacatcg

SEQ ID NO: 5656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccagcatgtctgaactgtggtatgcata

SEQ ID NO: 5657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccccagtgcggcattctctctctttacg

SEQ ID NO: 5658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccgacaccctgacccgcatgcgtcgcgc

SEQ ID NO: 5659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccgcgatgtatgcccagtgcagtggaag

SEQ ID NO: 5660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccgcggggtcgcagccagcccttgcaga

SEQ ID NO: 5661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccggatcagggcccacctgcatatttaa

SEQ ID NO: 5662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccggtttatggtagttcacctcgcgctt

SEQ ID NO: 5663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccgtcagaatttgcatccctcggacccc

SEQ ID NO: 5664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtccgtgatttacggtgagggaacttcaaa

SEQ ID NO: 5665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcgactttattactatcgatcgcgggtat

SEQ ID NO: 5666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcgagagggggtactgcgagcattggagc

SEQ ID NO: 5667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcgagttatttgtccaatatttatagcaa

SEQ ID NO: 5668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcgctgaaggttgatatcggagcccgtgc

SEQ ID NO: 5669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcgcttccatcggcctgtgtggcacggat

SEQ ID NO: 5670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggacaaggcggtccgtgaatcctcgaa

SEQ ID NO: 5671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggatcgggtgaacttttcggatatgtg

SEQ ID NO: 5672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggccgcatatgcttgtaggctgttgct

SEQ ID NO: 5673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggctgctagtccattagcctttagtgc

SEQ ID NO: 5674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggtactgtcgatgtacttttccatacg

SEQ ID NO: 5675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggtattgttggagcgcactggcctacg

SEQ ID NO: 5676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggtccctcaaatctgacgcgcgctcta

SEQ ID NO: 5677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggtcgattgcacctgggccaacatggg

SEQ ID NO: 5678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggtgccaatcctccctgtcttcacggg

SEQ ID NO: 5679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcggtgttgggcgttacataccgccctac

SEQ ID NO: 5680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcgtgtgagacgtacttcaacaattccgc

SEQ ID NO: 5681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctaacgctacgtcacttcagcttctctg

SEQ ID NO: 5682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctaactggaccggcgtcgtggagtgata

SEQ ID NO: 5683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctatgctcgggctgtaactacgtttact

SEQ ID NO: 5684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctcaacgggtcagtgtttctcgtaaagc

SEQ ID NO: 5685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctcattggggaagtcacactcaaatgag

SEQ ID NO: 5686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctccaaggtaccggagtatatgacggtt

SEQ ID NO: 5687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctccggaagatgctcagaaatatgaatg

SEQ ID NO: 5688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctcggatatttccgccctgcgaatctgc

SEQ ID NO: 5689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctgatgaagcagtaaagacatattggcg

SEQ ID NO: 5690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctgatgtgtctatagggttaccggctgc

SEQ ID NO: 5691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctgcaactgtgttagggttgtataccgg

SEQ ID NO: 5692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctgcgggttcgtcggtcattccgcctcc

SEQ ID NO: 5693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctgctggatttatggcgggtctcccgtg

SEQ ID NO: 5694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtctgtgtaagaatgtaagcttggctgcgg

SEQ ID NO: 5695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcttggtggaaccggattattgttagagg

SEQ ID NO: 5696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtcttttcgtaattccgcacagctttattg

SEQ ID NO: 5697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgaaacccgccatagaaggttcgttactc

SEQ ID NO: 5698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgaaataattgaaatatatttttgtggac

SEQ ID NO: 5699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgaaccgggagacctcaagcatcgtagac

SEQ ID NO: 5700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgaactgatcccttcctcagttacgagtg

SEQ ID NO: 5701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgaagcccctaggcaaggagttactgatc

SEQ ID NO: 5702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgacactagcacctgaggcgtgggattgg

SEQ ID NO: 5703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgacctaccgcaactgcgacactctcgcc

SEQ ID NO: 5704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgacgaggtctttctgcgtgcgagctgaa

SEQ ID NO: 5705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgacgtctcatctgtgtgggtcccctgcc

SEQ ID NO: 5706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgagaccaagatctaggtacgtccacgtg

SEQ ID NO: 5707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgagagtatccaagtgaatcagttgggac

SEQ ID NO: 5708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgagcagtcggggacaataggcgcacatg

SEQ ID NO: 5709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgagcgagagctgcattcaggatcctttc

SEQ ID NO: 5710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgagctacaagttattggattccgtgcac

SEQ ID NO: 5711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgagggacgggccattagaatccggttca

SEQ ID NO: 5712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgagttggctccacaacctaaggtccctg

SEQ ID NO: 5713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgataacagaacttccaccccgttggctt

SEQ ID NO: 5714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgatacaaacttgaagctttctaggcacc

SEQ ID NO: 5715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgatcctgttgaagtgaaatacaattatg

SEQ ID NO: 5716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgatctagcgttaaatcgcgtccacgtac

SEQ ID NO: 5717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgatttattgaccctgtgatgttttcagt

SEQ ID NO: 5718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcaaatctatcggacgttaaagcccaag

SEQ ID NO: 5719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcacggggatcaagcttggaagagtggg

SEQ ID NO: 5720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcaggtaggaagaaagtttggcgcccaa

SEQ ID NO: 5721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcatccgcacacccggataagcctcttc

SEQ ID NO: 5722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgccaattctcgcgctggggttgtagcac

SEQ ID NO: 5723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgccatggatagagcagctctattacctt

SEQ ID NO: 5724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcccttcttttctcgtactacagaaaag

SEQ ID NO: 5725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgccgattatcgcgtaggttctattgtct

SEQ ID NO: 5726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgccggattttttctgattcggtgaagta

SEQ ID NO: 5727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcgagtcgctcggtttctcgtttccacc

SEQ ID NO: 5728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcgcaggagccaggtcggcatcgagggg

SEQ ID NO: 5729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcgcaggttcaatcaatgtgtcagtccg

SEQ ID NO: 5730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcgcgccatacgagcaaacctccgtcgg

SEQ ID NO: 5731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcggcaagcagattcgcgagcggtggga

SEQ ID NO: 5732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcggcggcgtatacattgcgtgaaggaa

SEQ ID NO: 5733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcggggacggtaattcgatacgacgctg

SEQ ID NO: 5734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcggtgctgcatcgtgtcgaagcaaccg

SEQ ID NO: 5735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcggtggaggaggggcggtctatgaagc

SEQ ID NO: 5736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcgtcactaactctaggcatgcggggct

SEQ ID NO: 5737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgcgttgctcgaaggcgtaccacggcgtc

SEQ ID NO: 5738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgctaaagtcgcaataagagcgcgtggtg

SEQ ID NO: 5739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgctattttttccaaacaggagatgggca

SEQ ID NO: 5740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgctcgttcatcctttgtcattagcgggc

SEQ ID NO: 5741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgctgcttatcgtcctttctggctgtagg

SEQ ID NO: 5742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgctggtctcccctgctacctccggcatt

SEQ ID NO: 5743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgctggttcgggtagtcctcggggtaagg

SEQ ID NO: 5744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgctgtaaaccgtacggtattgcccagaa

SEQ ID NO: 5745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggaagccaaggcttcaatcgagtgcggc

SEQ ID NO: 5746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggaccacaatcgatccggcacggatgga

SEQ ID NO: 5747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggacggcaggatttagggtggggcggac

SEQ ID NO: 5748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggaggccagctggtactattgccccagg

SEQ ID NO: 5749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggaggtggctggcccgtgtgtccgacgt

SEQ ID NO: 5750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggataagacgagacgcgaaagcgatccg

SEQ ID NO: 5751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggcaggatggatgggagtttgctggtct

SEQ ID NO: 5752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggcatgagaactcagacatctatgcttg

SEQ ID NO: 5753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggcggtactcacaagaaactgttcccac

SEQ ID NO: 5754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggacccgtatacttgctaccgaaatac

SEQ ID NO: 5755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggacgttacttgctgtaaacccgcggc

SEQ ID NO: 5756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggacttcccgcggagtcggctgaaagc

SEQ ID NO: 5757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggagcccatttccccatcgcgatgtcg

SEQ ID NO: 5758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggagctgccaagctcgcagtttctccg

SEQ ID NO: 5759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggagtagatcctgtgaatttgatgtcc

SEQ ID NO: 5760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggattaagaacgatgcgaggctttgaa

SEQ ID NO: 5761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggcactcccaacgctcgcggagcgtga

SEQ ID NO: 5762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggcatacctaaacagcaaagaagatcc

SEQ ID NO: 5763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggccaattttgctgttattttctgcgt

SEQ ID NO: 5764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggcgcactttaacggtatggttttcgt

SEQ ID NO: 5765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggcgcgtcgttcagccagcggcgtgtt

SEQ ID NO: 5766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggggatgtcacttgtccctagcttccac

SEQ ID NO: 5767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggggcggttaaaccggtctgcttgagct

SEQ ID NO: 5768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggggctggattgcgattcggagcaggag

SEQ ID NO: 5769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggggtcagtttcacgtccccagcgttgc

SEQ ID NO: 5770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggtcgcgttgaggagctacgcacggcc

SEQ ID NO: 5771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgggttttagggacggttagattcactca

SEQ ID NO: 5772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggtaagtatccgacacttactaacgcgt

SEQ ID NO: 5773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggtagtgaggttgcgtgtgttcctcttg

SEQ ID NO: 5774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggtatagtgtaagagtcgaagtggtatg

SEQ ID NO: 5775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggtcacatctccaactaacggcactaac

SEQ ID NO: 5776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggtccaacttcctttgtcgggtgggggg

SEQ ID NO: 5777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggtgacgacttcaagcaaggtccccatg

SEQ ID NO: 5778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggttagcgctcgccacctgccattactc

SEQ ID NO: 5779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggttcgtcaagggatttcttgttgttgg

SEQ ID NO: 5780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtggttgacggggttaggtttgaacggatg

SEQ ID NO: 5781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtacagcacaaagggcctttcggttttg

SEQ ID NO: 5782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtacgtgattgaggcagttaagcatggg

SEQ ID NO: 5783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtagattgcgctaagacatgacaactcg

SEQ ID NO: 5784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtagcgcatcagtctggccagcatgacg

SEQ ID NO: 5785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtagtcggtgacacacacttcacgttcc

SEQ ID NO: 5786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtattcatgtactcaatcctgtaatagt

SEQ ID NO: 5787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtccatcgtgggcctacgggtgtttcgt

SEQ ID NO: 5788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtcgcgtatgcggtattgtccttcgccc

SEQ ID NO: 5789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtcgctctgtctgtggaatgcgaattgt

SEQ ID NO: 5790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtcttggtaatcggtttgtattgtctta

SEQ ID NO: 5791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtctttgttttatgggatgtaatccgtc

SEQ ID NO: 5792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtgcagtagttacggtgtggtgtgatgg

SEQ ID NO: 5793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtgcgttgtctgtcatgagagaatgtta

SEQ ID NO: 5794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtgggaatccagagcttacaggctgttg

SEQ ID NO: 5795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgtgtatgccagccgatggtcagtgtcgt

SEQ ID NO: 5796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgttcttaggcttccgggaaaatggcttt

SEQ ID NO: 5797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgttgattcctccgtatggtttggtctgg

SEQ ID NO: 5798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgttggtagtcataccccacgagtggtta

SEQ ID NO: 5799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtgttgtcgttccttgtgtgctgctatccg

SEQ ID NO: 5800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttaacccgactaggcagcagatgctttct

SEQ ID NO: 5801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttaacctgagcatatctgttagcacttgt

SEQ ID NO: 5802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttaacggcgtggtaggttcgtgcggcttc

SEQ ID NO: 5803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttaacggctgtcacatcgttatgactccg

SEQ ID NO: 5804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttaagcgaaccatctgaaagtgcgcacgg

SEQ ID NO: 5805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttaatcatcgcagcgacggctctcttctg

SEQ ID NO: 5806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttacaacttacatgcttatcctcggccat

SEQ ID NO: 5807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttaccagcgcgggttctcagtaagcgtag

SEQ ID NO: 5808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttacgaagctgctccgtttcggaaggcga

SEQ ID NO: 5809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttacgcctgaattatgcaccccacaaatt

SEQ ID NO: 5810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttacgctcggcgcttcctatgtacttgga

SEQ ID NO: 5811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttacggcacctggattccagtgctctaag

SEQ ID NO: 5812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttactctgaacgtcgtatagtgctaggtc

SEQ ID NO: 5813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttactgcgcgacagcaactggtgtgtttt

SEQ ID NO: 5814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttacttgctcaggagagatatatttaaga

SEQ ID NO: 5815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttagaagcgcaggtaattcccaaacctcg

SEQ ID NO: 5816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttagctagacccaagtgtgttttcgctag

SEQ ID NO: 5817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttagggcttaagcatcctgttcgggtaat

SEQ ID NO: 5818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttatacgacttcacgccagacgtacttcg

SEQ ID NO: 5819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcaagtcaacttcatcatgtttacgcgg

SEQ ID NO: 5820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcacgaggattcattatttcctatggtt

SEQ ID NO: 5821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcacgcaacacgcaggacatttcttctg

SEQ ID NO: 5822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcacttactggcttgtcgggtctccccg

SEQ ID NO: 5823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttccaataagtaatgggcttctgtgtctc

SEQ ID NO: 5824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttccagggttcttgcacatcttttcccgg

SEQ ID NO: 5825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttccgctttttctgagtatggcacgtctc

SEQ ID NO: 5826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttccggctcgctttggggaccgtgttacg

SEQ ID NO: 5827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttccgtactctatctggtaaaatcgtagg

SEQ ID NO: 5828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgacgtttggcaagattcaagtctatc

SEQ ID NO: 5829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgactatatccgttttgtgtgcgtggt

SEQ ID NO: 5830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgcaaaaaatcgtttgctgttgcaggt

SEQ ID NO: 5831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgccgctccgagcagatgacgtcgggt

SEQ ID NO: 5832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgctcagcagtgatctttttggcgtga

SEQ ID NO: 5833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcggccgacacgaaagctgttatgggga

SEQ ID NO: 5834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcggctagtgcgaagtgcgtttcgtcat

SEQ ID NO: 5835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgggacaggatttcgcgagggcctggt

SEQ ID NO: 5836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgtgtgtcacggttcggtaccgccccg

SEQ ID NO: 5837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttcgttgctgccagcatttccgggggtaa

SEQ ID NO: 5838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttctgcgtagggaaatgggcttgaacaag

SEQ ID NO: 5839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgaactgcgctacgtgccacacatttcc

SEQ ID NO: 5840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgacccctaagctgcgtaagaatttaca

SEQ ID NO: 5841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgacccgccacattgaacattcgtagtc

SEQ ID NO: 5842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgactccgggccttcatcataacacacc

SEQ ID NO: 5843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgagcacatcattagctgctgcgttgat

SEQ ID NO: 5844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgagctggtgtatgtagttagcgtcatg

SEQ ID NO: 5845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgagctgtgtaggtgaaggatattccgg

SEQ ID NO: 5846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgatccggatcttttttggagtagttct

SEQ ID NO: 5847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgcacgcctagggtgcggttgcatgact

SEQ ID NO: 5848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgccttgactatcgaagaaggctatgca

SEQ ID NO: 5849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgcgcccgcctctatcagatcccgtggt

SEQ ID NO: 5850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgcgccgaagtgtgagaccacgccagcg

SEQ ID NO: 5851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgcgcgtaagtcgccgaggcttatcagg

SEQ ID NO: 5852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgcggatcacactggctttggcgctttg

SEQ ID NO: 5853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgcggtaatagtgttaatgtagcatcct

SEQ ID NO: 5854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgctgaccatacgttatacagtcgattg

SEQ ID NO: 5855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttggcggtcatgtagttcgtttttcccga

SEQ ID NO: 5856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgggcgaagtttagaagggcatcggttt

SEQ ID NO: 5857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgggtcaggtaacaactctacacgcacc

SEQ ID NO: 5858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttggtacctccctagcgctgcatgccttg

SEQ ID NO: 5859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttggttacccgagcatcttagttaggatt

SEQ ID NO: 5860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgtgcgacattatttactcctgctgacg

SEQ ID NO: 5861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgttcacgtgaacgcggcgtctctgtcc

SEQ ID NO: 5862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttgttcgaggcaggcgggagtatcaggcg

SEQ ID NO: 5863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttaagaactagacgtacggtcggcaggt

SEQ ID NO: 5864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttaatacagcattgagaccgcggacgac

SEQ ID NO: 5865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttacacgcgatgatatctgcaaattgct

SEQ ID NO: 5866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttagctaacccctgctcggtttactccg

SEQ ID NO: 5867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttcacggtccagtgtataaggatccgaa

SEQ ID NO: 5868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttccgggtacgccaatcgctttacatat

SEQ ID NO: 5869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttcgcccgtatgcgatcattagtcactc

SEQ ID NO: 5870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttgaggatccgaatcgtgttcgaatgtt

SEQ ID NO: 5871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttgattaacttttatgttaaagtgtcgc

SEQ ID NO: 5872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttgattagcagggcgagtcatatttttt

SEQ ID NO: 5873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttgccaacgacgaataaccttgaccttc

SEQ ID NO: 5874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttggactcatgggttggttatacccacg

SEQ ID NO: 5875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttggggtggccctcttggatatggtgca

SEQ ID NO: 5876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttgtcggttgtgctggccagcacgggct

SEQ ID NO: 5877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttttcaatttcctcgcccgtgccgcgatg

SEQ ID NO: 5878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttttcagtgttctgctagtggttttcgtt

SEQ ID NO: 5879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgttttgggataagccctgggtgatttggcg

SEQ ID NO: 5880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acgtttttctgtaaagatggaagcgcgacgtg

SEQ ID NO: 5881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaaaaccggaatatggggaagtgacccgta

SEQ ID NO: 5882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaaaagtggcacgctaccatcgagtcttgg

SEQ ID NO: 5883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaaagggagatgtctgatctaggtataatt

SEQ ID NO: 5884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacacgctggcttcgtcgacggaatagga

SEQ ID NO: 5885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacacggtgaaaggtgcctatagcctctc

SEQ ID NO: 5886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacagtcgagcggtgggtcaccctacgca

SEQ ID NO: 5887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacagtgcgttgagtcggcgggcgtttgt

SEQ ID NO: 5888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacctaccacgcttgatggtttagcgggc

SEQ ID NO: 5889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacgacttgagtgtgattatcgacgtttg

SEQ ID NO: 5890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacgcgataattccgcataggtgtattcg

SEQ ID NO: 5891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacgctgaatttacatcgcgtccttgaat

SEQ ID NO: 5892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacgctgctcaagtccatggccccggacg

SEQ ID NO: 5893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacgctgtcgggaagagctgttgcagagg

SEQ ID NO: 5894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacgtctcgggtcttggagggggcggggg

SEQ ID NO: 5895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaactcgaataagcgggaaaagataccgtg

SEQ ID NO: 5896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaacttgaactaaatggatttggtagtcgg

SEQ ID NO: 5897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagactcgcacgtgatattgattcttgcc

SEQ ID NO: 5898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagattcagacgtctctcttttggggggg

SEQ ID NO: 5899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagcccagtttgtatcggaaaggccgcgg

SEQ ID NO: 5900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagcgaccatgcccgagagtggtgtacac

SEQ ID NO: 5901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagcgctcaggcacatgtcaaccagtgga

SEQ ID NO: 5902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagcttggaatggtttagggaggtcaggg

SEQ ID NO: 5903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagggccgccgacaggttgacggattcgt

SEQ ID NO: 5904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaaggtgcgtactggctacgacgccccaac

SEQ ID NO: 5905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagtatacgggctattagtgtaacaatcg

SEQ ID NO: 5906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaagtttcccctatacgttcagaaagctaa

SEQ ID NO: 5907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaataacctcggtcgttcaggtggatcttt

SEQ ID NO: 5908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaatatcgaggaacgcgtcgtatatttatg

SEQ ID NO: 5909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaatattgcggctagatgatccacaggccg

SEQ ID NO: 5910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaatcgggtcattttctaggtttcgcacgg

SEQ ID NO: 5911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaatcgttgggttgctacgttccatggcga

SEQ ID NO: 5912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaatgcacgtctatgattccgcaggggcca

SEQ ID NO: 5913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaatggaaccggcgcttacgttttgatctc

SEQ ID NO: 5914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaatggagcccggtccacatggtattttga

SEQ ID NO: 5915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaattgttgtagcgcgaatagtaggtgtcc

SEQ ID NO: 5916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacaacaagaccgccacacacatgctgaca

SEQ ID NO: 5917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacaacggggtgatgtaatagattttcggc

SEQ ID NO: 5918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacaagcggagtgacggtccttcggtgtcc

SEQ ID NO: 5919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacaatccagtgtgcccgcctcttcaaccg

SEQ ID NO: 5920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacaatgatgtgcgggcaaaatgcatactt

SEQ ID NO: 5921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacacaatcaagtgactttaaccgtggcga

SEQ ID NO: 5922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacactttaagctgccgcgttacggggttg

SEQ ID NO: 5923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacagagcctagggaatcgccggtctagtg

SEQ ID NO: 5924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacagccgtgcgtttcagtgcgtggaaaac

SEQ ID NO: 5925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacagctgcactgacccctttttatgtcct

SEQ ID NO: 5926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacaggacatcacgatacgtcacggcggcg

SEQ ID NO: 5927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacagtacggcgcttcttctgattccgggt

SEQ ID NO: 5928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacatacagttctgctacggcgcatcatga

SEQ ID NO: 5929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacatcagtgcgtcatgcctgcaggtgcgc

SEQ ID NO: 5930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacatccgctaccctcattggcgtcggaga

SEQ ID NO: 5931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacatgaggccttaggacctgtcccagctt

SEQ ID NO: 5932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaccagaaggggtcagtttatgggtggtat

SEQ ID NO: 5933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacccagctaaaatagtagtctgactgtta

SEQ ID NO: 5934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacccagtggtggaagactgattatgcgca

SEQ ID NO: 5935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaccccacaagttacgtattataacggccg

SEQ ID NO: 5936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacccggacagtatcgacgagcagtgggga

SEQ ID NO: 5937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaccgactgctgacagggcataatgttcgg

SEQ ID NO: 5938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaccgtgcgtggattggggaaacacctctt

SEQ ID NO: 5939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaccgttgataatttgaccagttcaccgct

SEQ ID NO: 5940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaccgtttatcatcttgtcgtcttttgatt

SEQ ID NO: 5941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacctgttctaggatttcctgtcgggctat

SEQ ID NO: 5942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacgccccacggtgtgtctggtcacgagga

SEQ ID NO: 5943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacgcgaagttgatccgagttgagttgctg

SEQ ID NO: 5944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacgctcgcactggtgatggaaactcgcgg

SEQ ID NO: 5945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacggaagtcgtttcagttgggcagagtat

SEQ ID NO: 5946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacggccatcgtgtaggaattgggttatca

SEQ ID NO: 5947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacggcgggagtgggctcagtgatacccgt

SEQ ID NO: 5948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacggtactggttctttcttgtgcacccga

SEQ ID NO: 5949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacggtttagcttggctcaatcgggccaat

SEQ ID NO: 5950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacgtgaccgcattaagtattctgagcagg

SEQ ID NO: 5951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacgtgcacgtggtcggtgctatcaacaag

SEQ ID NO: 5952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacgttggtaatccctgaactgggggctcg

SEQ ID NO: 5953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actactactacgcggtaagtcaatgaattggg

SEQ ID NO: 5954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actactagcacaaaaggggtgagccaggactc

SEQ ID NO: 5955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actactcattactgggcgccgtttcgtgcgat

SEQ ID NO: 5956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actactgaggagtcagtcggcgtcatattcgg

SEQ ID NO: 5957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actactgtagggagcgcgagagagttgtctgc

SEQ ID NO: 5958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacttcctgaatgcgagagtacccgtgtgg

SEQ ID NO: 5959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacttggtccgatcggtgaggtagaaggcg

SEQ ID NO: 5960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actactttatccggttctacccacggagttct

SEQ ID NO: 5961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actacttttattcctgctctgtgtctggtgtg

SEQ ID NO: 5962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagaacaacgctttactcagcgggaagtag

SEQ ID NO: 5963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagaacgggtgcgtagccagggctaacctc

SEQ ID NO: 5964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagaacgtggtcgctctgatgctttaccgc

SEQ ID NO: 5965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagacccgcccaccttacagagtacttgcg

SEQ ID NO: 5966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagacgatgaaatgtatgatttgctgaacc

SEQ ID NO: 5967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagagatggttgagcgcgcagtacaccgtc

SEQ ID NO: 5968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagagtacgggatttatggctctcagttta

SEQ ID NO: 5969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagatattgctcatacacaactgattcgtg

SEQ ID NO: 5970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagatggttctgatgaagctcgttggtctg

SEQ ID NO: 5971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagcaacattcagagaaagattgttgacac

SEQ ID NO: 5972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagccaccccgcgccctgagatatacacgg

SEQ ID NO: 5973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagcccctgcactctaatcctaacgttggc

SEQ ID NO: 5974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagccgcagcacgttccttattcttggccg

SEQ ID NO: 5975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagcgaggatattgctacgaattgttgcca

SEQ ID NO: 5976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagcgcttgtaactggtaaggggtgcttgg

SEQ ID NO: 5977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagcgggcatgggcttcattcgacctgatg

SEQ ID NO: 5978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagcggggacgtcaatttcacgaacagatg

SEQ ID NO: 5979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagctcacggaggggatagatttttaagtt

SEQ ID NO: 5980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagctgcagccttaactcgttggtctgttt

SEQ ID NO: 5981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagcttttgcgccaattcgcgacgcactgg

SEQ ID NO: 5982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggaaagtgactgcttgccgcctcctggg

SEQ ID NO: 5983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggacgcccaataaagaggtaggaaacaa

SEQ ID NO: 5984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggcatatcgtgcatcggtatgcgttcaa

SEQ ID NO: 5985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggccagccccactttagttcttgggtgc

SEQ ID NO: 5986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggcggcttactcgtgaacatcaggatct

SEQ ID NO: 5987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggcgtcaaccgtatggatggcgggagga

SEQ ID NO: 5988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagggagattggacgcgctagctagtgaca

SEQ ID NO: 5989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggggatccgtacgcgtggtgggatgggc

SEQ ID NO: 5990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagggggttgcttggtggcttggattgcac

SEQ ID NO: 5991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggggtttagggtgtcgtagtccttagcg

SEQ ID NO: 5992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagggtcatcagcactcaaccacgattatt

SEQ ID NO: 5993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggtcatacttggctaactgcgggtgaga

SEQ ID NO: 5994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggtgcttgcagttatctaagttgtcggc

SEQ ID NO: 5995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actaggtgtcccaggtagcgcacattctgtct

SEQ ID NO: 5996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagtaaagaacgccaacgccatcgaccgcc

SEQ ID NO: 5997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagtatgctccgtcttggtcgagctgggtt

SEQ ID NO: 5998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagtcaaagttcgaagccggacggtttcag

SEQ ID NO: 5999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagtccgaggtatgaccctcctcctcggga

SEQ ID NO: 6000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagtggtctagtttagtatgtccgtacctc

SEQ ID NO: 6001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagtgtgtgacatttaccttttcgagctcg

SEQ ID NO: 6002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagtgttgttggacgggaggctcttaatgg

SEQ ID NO: 6003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagttacatcaacaccacctctcgattgtg

SEQ ID NO: 6004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagttcgcgtcgctttgagctcgcgtcggg

SEQ ID NO: 6005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagttcttttgcatgcttgtggctccgctg

SEQ ID NO: 6006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actagttgataccccaagcttattgccagctg

SEQ ID NO: 6007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actataaccctcgcatacgcaacgtcatggtg

SEQ ID NO: 6008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actataagcaaggtgtcaagcgaatagctccc

SEQ ID NO: 6009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatactaatcgacctccggtatcgggcata

SEQ ID NO: 6010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatagagggccccgagaacacatctgttac

SEQ ID NO: 6011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatagggaccgaccggttgcgcattcaaaa

SEQ ID NO: 6012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actataggtttgtatcacttaatgggtggttc

SEQ ID NO: 6013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatatcgatgtgtaggggctgtgtctgtca

SEQ ID NO: 6014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatatctgctatcgggagattcgtatcggc

SEQ ID NO: 6015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatatgcggtttcgactcctacctactcac

SEQ ID NO: 6016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatcaatcaggtgctagctagacgacactc

SEQ ID NO: 6017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatcaggctggcggggacgagatgtgtacc

SEQ ID NO: 6018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatcgagtcagcagagttgttaccctgata

SEQ ID NO: 6019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatcgatcaatagcgacgtcagtacggggg

SEQ ID NO: 6020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatcgcgaaactccacaggttcagcagact

SEQ ID NO: 6021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatcggtagtaggtggtgggggctctgtca

SEQ ID NO: 6022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatcgtttcgagccattaatgccgccttta

SEQ ID NO: 6023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatctcctagggctggggcttccaatacgt

SEQ ID NO: 6024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgacatccatctcacagaagagcctgta

SEQ ID NO: 6025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgacgaggggactacacggactgggcgt

SEQ ID NO: 6026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgaggatggggcgtttcggacccgtcta

SEQ ID NO: 6027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgaggtagtgtagatcatcttcatgcta

SEQ ID NO: 6028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgcccgcaccgtcttgggtcacagcggc

SEQ ID NO: 6029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgcttctctggatcgttgttatcatgtt

SEQ ID NO: 6030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatggcctcaggggtcacatgacattgcgt

SEQ ID NO: 6031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatggctcttcgtcaggcacttacatgata

SEQ ID NO: 6032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgggttgttcagccttctcgcgaatact

SEQ ID NO: 6033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatggtagcgataacggtgaggaggtgagt

SEQ ID NO: 6034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgtcgcgatagtagcggctgcttcgggt

SEQ ID NO: 6035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgtggccctttccttttgatcatgcgcg

SEQ ID NO: 6036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actatgttttgtgcttgaatgtctttttgtgt

SEQ ID NO: 6037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattaggccagtattgatggccccgctctg

SEQ ID NO: 6038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattaggcggataaagctgcttttgtccct

SEQ ID NO: 6039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattcatacctctgacatgctgagttggcc

SEQ ID NO: 6040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattccgttctagttagcaacaagtttttg

SEQ ID NO: 6041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattcgggatgtgttaaaacaatcttcgtg

SEQ ID NO: 6042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattcgtctttcccagcggaagccatattc

SEQ ID NO: 6043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattctgatcaagcggcagtaggagtgggg

SEQ ID NO: 6044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattgaagcaggacttgacatatgcctgga

SEQ ID NO: 6045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattgatttagagcacaacaccgaaaacca

SEQ ID NO: 6046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattgcgcggtagtgccggggtggggttgc

SEQ ID NO: 6047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actattgtgttactattgtcgctaattggacc

SEQ ID NO: 6048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaaaaggatacgtatcggagggcacgtcc

SEQ ID NO: 6049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaaagaacggcagtaggtacttgtaatgt

SEQ ID NO: 6050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaaagtcaagtgactctatgcatatctgg

SEQ ID NO: 6051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaacacatgatgtgggttcctgttgtaac

SEQ ID NO: 6052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaacgcaacgactcgtcgcctagcgattg

SEQ ID NO: 6053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaacttcttgtgatcacccaggtacgcct

SEQ ID NO: 6054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaagagagcaacatactactggggcgtat

SEQ ID NO: 6055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaagccccctaagacggcgttcttgctgt

SEQ ID NO: 6056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaagctcgcatctaatcagtgtcgcagcg

SEQ ID NO: 6057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaaggcggttgtcatattttcacctcgaa

SEQ ID NO: 6058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaagtaactggcttgatcaaaaagttagc

SEQ ID NO: 6059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaagttgctattgtaactcgcgccatgat

SEQ ID NO: 6060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaatcgtccaaacccgtcgttgagccttg

SEQ ID NO: 6061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaatctgtccgtcccgaacgatgtgtaca

SEQ ID NO: 6062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacaaccggcgagaggacgggcagcgttt

SEQ ID NO: 6063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacacaatcttgattctacagtagccgcc

SEQ ID NO: 6064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacagaccggcgcaggctccggggatgcg

SEQ ID NO: 6065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacataccggtgcggtgttggataagctt

SEQ ID NO: 6066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacatgtgaagctccactataaagtgaat

SEQ ID NO: 6067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacattaatgctctgtcacgcgcaaccgg

SEQ ID NO: 6068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacattctgcgggtgaggaattagtatct

SEQ ID NO: 6069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacatttctgctttttggtcatggtattt

SEQ ID NO: 6070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaccaattcagctgcggtcggacaccaat

SEQ ID NO: 6071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaccggtgcgtgtctttagattctatggg

SEQ ID NO: 6072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacgtgagggatttaaatttttttaaggg

SEQ ID NO: 6073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacgtgccaaattccaggggcgacggtgg

SEQ ID NO: 6074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcacgttgatttgagctgaccgtttagaac

SEQ ID NO: 6075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcactcgggaaccgggggacaggtttggct

SEQ ID NO: 6076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcactgaaattcttaagcgagttaccgagt

SEQ ID NO: 6077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcactggtcggcgatcataattgatttcat

SEQ ID NO: 6078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcactgttgtcatgacgcaacgcggtgatt

SEQ ID NO: 6079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcagaccgacggaacgttcggtctacgtcg

SEQ ID NO: 6080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcagagttacccaggagacgtctataaggc

SEQ ID NO: 6081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcagctatcgacttacgtgtactacttgct

SEQ ID NO: 6082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaggcctcccccatcctatatgtggccac

SEQ ID NO: 6083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcagggaagaattttgtgagcggggtaggg

SEQ ID NO: 6084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcaggtttaaaattgggatatgtacatagg

SEQ ID NO: 6085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcagtaatgggagcgaacactgttcagttt

SEQ ID NO: 6086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcagtgtgtcagcaagatcggccagggaga

SEQ ID NO: 6087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcataaccagcctccattttcatcttcgcc

SEQ ID NO: 6088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcataaccgtctggatctaatgtgtggcgg

SEQ ID NO: 6089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatatacgtttagaaacattcatatcacc

SEQ ID NO: 6090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatccatacgaattgcatcctcacagggg

SEQ ID NO: 6091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatctatccatgttactgtttgtaccagt

SEQ ID NO: 6092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatgaacgagtgggattggctaccctgtg

SEQ ID NO: 6093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatgagatgtctttttgatacgcctgttt

SEQ ID NO: 6094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatgccgggcgggtcgacgtgggcctggg

SEQ ID NO: 6095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatgcctctcgcggccatttccacgatcg

SEQ ID NO: 6096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatggccagtacagggctctcggcgatca

SEQ ID NO: 6097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatgtcagaaaggtggaacatgagcttgt

SEQ ID NO: 6098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcattattcgaccacagcccgagggagtgt

SEQ ID NO: 6099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcattcagctcctgtcctcccttcgacacg

SEQ ID NO: 6100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcattgcgtgacctctaccctgcgcggacg

SEQ ID NO: 6101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcattgggtcggcatgtccaggccaatcct

SEQ ID NO: 6102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcatttgtcctgcaccctgccttcccaatg

SEQ ID NO: 6103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccacccttgggccggtataggacttccgg

SEQ ID NO: 6104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccactgctcgtttatttgggtaagtccgt

SEQ ID NO: 6105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccagcacgacggggggtttcgggttcgag

SEQ ID NO: 6106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccaggggacgtcgagtggaggccatgcac

SEQ ID NO: 6107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccagtccgtttcaatgttgggccttaatt

SEQ ID NO: 6108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccatgatagatcggatgaaagggaccctg

SEQ ID NO: 6109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccaacagagggttctgtggtctcggcgt

SEQ ID NO: 6110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccaatgtggatcacccatgttatgttct

SEQ ID NO: 6111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccacgctcgttgatatggatgctggcca

SEQ ID NO: 6112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccacgttgccgatgcactgcccagagaa

SEQ ID NO: 6113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccactcagccgtgtactaacatgcacca

SEQ ID NO: 6114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccagttatcatgacttaattagctacgg

SEQ ID NO: 6115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccatgtgcgacgccgggtgggccgcatg

SEQ ID NO: 6116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccccacgcgttaggtcatgggcagcagtg

SEQ ID NO: 6117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccccatgggtgcttccccttgtgctaggt

SEQ ID NO: 6118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccccgcaggcacccgagagtttgagtct

SEQ ID NO: 6119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccccgtctgcgttcccgatgttgctatga

SEQ ID NO: 6120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccctctcgtcatctaggaagcaaggttt

SEQ ID NO: 6121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccctgccgtggtctttgacttgcccgct

SEQ ID NO: 6122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccctgcgactctcaggtttatgtcgatc

SEQ ID NO: 6123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccccttagttgtgacaggaacggctgagg

SEQ ID NO: 6124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccgatggtgttcgacatgaaacattctg

SEQ ID NO: 6125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccgatgtctgtcggcaacgcgcgccgta

SEQ ID NO: 6126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccgccatatagttatgccataaaacggg

SEQ ID NO: 6127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccgcctgccacgttgatcatttctatgt

SEQ ID NO: 6128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccgggaggaggcggtcaaaggtgggggt

SEQ ID NO: 6129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccggtattcacctccgattatgaatata

SEQ ID NO: 6130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccgtctctaggtcgatgtgcacctcggc

SEQ ID NO: 6131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccctcgaacttcagaccccgcacctctgc

SEQ ID NO: 6132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccctgcgcttcgaggctcgataccacatg

SEQ ID NO: 6133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccctggtagcccgcagcaaggcgatagga

SEQ ID NO: 6134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcccttcacccatggggttcggctccgggt

SEQ ID NO: 6135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgaagcttcacgctaccagaccgtatgt

SEQ ID NO: 6136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgacaaccgcgctgtcttaccgtatcca

SEQ ID NO: 6137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgagagcgactaccttggatgaacacgc

SEQ ID NO: 6138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgataggcgccaggccggatgcagtgtg

SEQ ID NO: 6139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgatatgggctggcggttaatgggcaaa

SEQ ID NO: 6140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgatgttcgttgtgacaatgtcgaatcg

SEQ ID NO: 6141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgattccacgttaccggtacccttgccg

SEQ ID NO: 6142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgcaggggcctgaatggtctcgaactac

SEQ ID NO: 6143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgcatatcggacttgcaatcgcctatga

SEQ ID NO: 6144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgccgtgactcgttcaaaattgtcctac

SEQ ID NO: 6145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgctcaagtgccatcgggtctaccgtgg

SEQ ID NO: 6146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggaagccgctcatgccatcgtcatggt

SEQ ID NO: 6147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggacgcttcggtttccataccatcaca

SEQ ID NO: 6148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggagtggaggcatgagctccagcgatc

SEQ ID NO: 6149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggatgtatctaagcgctgggattgggg

SEQ ID NO: 6150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggcacatgattctgctacacgccccgg

SEQ ID NO: 6151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggcagacctcaccacgtgtccacagtc

SEQ ID NO: 6152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggccactaataattgcatttctgttgt

SEQ ID NO: 6153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccggccgttacttcttgactgatgccaca

SEQ ID NO: 6154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgtcggcattgtgggttatctgcatgtt

SEQ ID NO: 6155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgtgtcggccccccacaatagttactct

SEQ ID NO: 6156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgtgttccgtacataatacgcccgcttg

SEQ ID NO: 6157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgtttcagttatagtgggatggtcctct

SEQ ID NO: 6158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccgtttgtcgcgttcgttttgaggtgtat

SEQ ID NO: 6159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctaatcccacggggtcgaccggtagcga

SEQ ID NO: 6160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctagacctcacttcgaggggaacgcggt

SEQ ID NO: 6161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctagcgctccctcacacgtaggtgcccc

SEQ ID NO: 6162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctcacacctgtcgctgctgtattaatgg

SEQ ID NO: 6163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctccggtggtatcgttgggggcagctgg

SEQ ID NO: 6164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctgacagcctttcactatcctccgtggc

SEQ ID NO: 6165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctggcgcaagggctacggttcgtgttac

SEQ ID NO: 6166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctggggggtggaaattgatgaaggtgtt

SEQ ID NO: 6167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctggttccttccacggtcgagtgccagc

SEQ ID NO: 6168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcctgtctgattacacgggtagtttagtcc

SEQ ID NO: 6169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actccttgcttccttcttagtttttcgcggta

SEQ ID NO: 6170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgaacaaacatgcgtgcagcacaaaatga

SEQ ID NO: 6171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgaacaacagcacgtcctgcttcatgtcg

SEQ ID NO: 6172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgaactgagttttagtattctcagcacac

SEQ ID NO: 6173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgacacacgctacgttagccttacggttt

SEQ ID NO: 6174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgaccagcgatcttgtccgcatagaggtg

SEQ ID NO: 6175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgaccctgaacatgcaagcgtgagttaac

SEQ ID NO: 6176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgacgccgtagacaatgggtgcctggggg

SEQ ID NO: 6177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgacgtggcgctttagcgatgaaggagtc

SEQ ID NO: 6178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgactgacatatatggctgagctggggtg

SEQ ID NO: 6179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgactgccggcgaaccactgtgacaccgc

SEQ ID NO: 6180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgagaagtgagcatcgcacagacggcgtt

SEQ ID NO: 6181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgagaggcaaggcggggattgaacgctcg

SEQ ID NO: 6182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgagagttagtgatgtggtggcaagcgaa

SEQ ID NO: 6183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgaggcgatgtgtttgggcccaaggtagc

SEQ ID NO: 6184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgagtcgattctttgtgttaacgtgtgtg

SEQ ID NO: 6185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgagtggtgctacatcgctcattgttatc

SEQ ID NO: 6186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgagttcccaacactccctactcactagt

SEQ ID NO: 6187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgatcatgatgtccttcagtttcacgtcc

SEQ ID NO: 6188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcacgctgtttgctaacctctcggctta

SEQ ID NO: 6189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcactatgggaccagtatctgtgggttt

SEQ ID NO: 6190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcagggaacgccaggttctcagctgtct

SEQ ID NO: 6191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcatatctagatctctcgctacgatttc

SEQ ID NO: 6192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcatgggtacggcacaatgcttacgggg

SEQ ID NO: 6193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgccactggacatagaacttcgactcgcg

SEQ ID NO: 6194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcccccacgacgtcatctcccgccggtt

SEQ ID NO: 6195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgccctgactttgccagcctgggcacgcg

SEQ ID NO: 6196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgccgccgcgcggtaccgaactgaagatc

SEQ ID NO: 6197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgccggtcagcaacgtggtcgcccgtgga

SEQ ID NO: 6198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcctctgacatgtaggaggatcgagcgg

SEQ ID NO: 6199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcggccagctataggtggaggcgtcgcg

SEQ ID NO: 6200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcggctgaaggagtattgcttggtctca

SEQ ID NO: 6201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgcgggcagcaaccttggatgtaggacac

SEQ ID NO: 6202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgctacatatgtggacgacaccggcggcg

SEQ ID NO: 6203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgctctggcactttttaagtccaactgcc

SEQ ID NO: 6204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgctgagaaacatctctggagcattcctt

SEQ ID NO: 6205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgctgattatcttaacctgttaccggtgt

SEQ ID NO: 6206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggaacaggagcgcttgttgcatggccgc

SEQ ID NO: 6207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggaacgtcaaagcggtttggggcagggg

SEQ ID NO: 6208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggacaagcaaaatctatggccacccgca

SEQ ID NO: 6209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggactcccgcatgatgactggtctactc

SEQ ID NO: 6210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggagataaatgagttactggcgaatgga

SEQ ID NO: 6211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggatccgttgtagcctattacctgtggc

SEQ ID NO: 6212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggatcgcggggggttaggatcagcgttg

SEQ ID NO: 6213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggcaatgcagtcgcagtgatttattagg

SEQ ID NO: 6214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggcagactcgaggtccaatcggataccc

SEQ ID NO: 6215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggccaaatagtgtcaaccaggccacgat

SEQ ID NO: 6216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggccgatccttcttcgtctcggggcggt

SEQ ID NO: 6217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggcgtgcaatgacctggtggtacctgtg

SEQ ID NO: 6218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggcgtgcagattcggtcacgtttgtctg

SEQ ID NO: 6219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgggaatgcgaactcggctacccctctgt

SEQ ID NO: 6220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgggacctaaacaggaggccttgcttgag

SEQ ID NO: 6221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgggacctgcggacttaggccagaaaacg

SEQ ID NO: 6222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgggagctcttctccttggggtaagcgtc

SEQ ID NO: 6223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgggaggcgaagtgggtcctaggcaaggg

SEQ ID NO: 6224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgggccgattaaaacgcgcgatgaattac

SEQ ID NO: 6225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggggagaaaaccaacggcactgcacatt

SEQ ID NO: 6226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggggcgtgtttatatccctgctgatagc

SEQ ID NO: 6227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggggttgggacttttgtcgcggttatat

SEQ ID NO: 6228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgggttgggcgtactgtattgtcggggac

SEQ ID NO: 6229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtaaatgtttctggcgtgctatcgagc

SEQ ID NO: 6230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtcgtgcgagaccgtgtcgggcagggg

SEQ ID NO: 6231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtgcactttcgctcgacaaactgggcc

SEQ ID NO: 6232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtggcattacatgtaatattgagtcgc

SEQ ID NO: 6233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtgggtacggtctacatcggcatttgt

SEQ ID NO: 6234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtgtatgcggtttagcctatgaagatc

SEQ ID NO: 6235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtgttagggctgttccatctcaggagt

SEQ ID NO: 6236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcggtgtttggggtcgaccgtacgcttggc

SEQ ID NO: 6237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtaaatcacccaatcgacattaagctcg

SEQ ID NO: 6238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtaacctgtgcaatcgtatactctaacg

SEQ ID NO: 6239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtacgcacctctgtcacggtattttacc

SEQ ID NO: 6240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtacgccttagggattgggaggagcgct

SEQ ID NO: 6241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtctaagccggtttcgtacgcgcacacc

SEQ ID NO: 6242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtggcccgcggagttctcgaggaccggt

SEQ ID NO: 6243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtggcggataagagcgggcctgcaatca

SEQ ID NO: 6244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtgggatttcgaatcaggttcttttcca

SEQ ID NO: 6245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttagattagggcacaactccgcgcagt

SEQ ID NO: 6246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttatggatcgatcatgcagtccgacct

SEQ ID NO: 6247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttcacgggggcgaacaacctacagcgt

SEQ ID NO: 6248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttcatcaggcatcctcgtgctggcgat

SEQ ID NO: 6249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttgagttccggggtttcgttgggggtt

SEQ ID NO: 6250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttgggatccttaccagtcatcctctca

SEQ ID NO: 6251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttgtgctgttgtggtcacgcaggttat

SEQ ID NO: 6252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtttgcgtgtggctcaactccaaggtca

SEQ ID NO: 6253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgtttgctggcactgatattgcctcgcca

SEQ ID NO: 6254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcgttttagtcggtcgggattggcgatggc

SEQ ID NO: 6255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctaaattagtccctcgacactaaatctgt

SEQ ID NO: 6256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctaagcacagagcaggatgggggccgcgt

SEQ ID NO: 6257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctacgacgcatagaggtggcacttccccg

SEQ ID NO: 6258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctacgttcgagtttcatcgcagttcaatc

SEQ ID NO: 6259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctagcgactccgacccgttggctccctgc

SEQ ID NO: 6260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctaggtgaagaaccggaagcacgcgggtt

SEQ ID NO: 6261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctatgcgtgcaagatgcttatcacagcat

SEQ ID NO: 6262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctcaggtggtgtatatgtgaccgcttgta

SEQ ID NO: 6263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctccgcctgggccagacacttggttgggt

SEQ ID NO: 6264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctcgatcaagcaaccaatgaggacgcctc

SEQ ID NO: 6265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctcgatcacacacgtttcttcctgcattt

SEQ ID NO: 6266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctgaactttcattaccctgtcgcgtggcc

SEQ ID NO: 6267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctgccggcgtttcgtgtagggccataggc

SEQ ID NO: 6268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctgcgcgccttgtaggattggacctgcca

SEQ ID NO: 6269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctggattctgtggtgttggggtgggttag

SEQ ID NO: 6270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctggcatagttcgagagaaccagtggtgc

SEQ ID NO: 6271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctggtgatggctgtcgtgcagggggttag

SEQ ID NO: 6272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctgtccacggaagcatttgcgcggcccac

SEQ ID NO: 6273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctgtcggtagtggctgacctgccctgttc

SEQ ID NO: 6274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcttccgggcaggtaggggcaccgaaatcg

SEQ ID NO: 6275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcttccgtttaagacgatggttgtcactga

SEQ ID NO: 6276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcttcgcgcggtttccacaaatctgctcgg

SEQ ID NO: 6277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcttctttgggtatttaatctccttggcgt

SEQ ID NO: 6278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcttgagcagggggcgggggcgtctaatgc

SEQ ID NO: 6279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actcttggaaggagcgtttttgatggaatttg

SEQ ID NO: 6280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actctttggtatcagcaacgttcagtacagcg

SEQ ID NO: 6281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaacaacgtcaaggagagaaacatgaaag

SEQ ID NO: 6282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaacacggacagcgtagggaggtgtgcct

SEQ ID NO: 6283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaactatcgaatcagcaacgaggtcatgc

SEQ ID NO: 6284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaagcttagggcgtttcactggcggtaac

SEQ ID NO: 6285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaaggatctgcaacataatcgccacggct

SEQ ID NO: 6286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaatcacgcatgcttcatccaagggtcgc

SEQ ID NO: 6287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacagatgcatgagtgcctggggtggcct

SEQ ID NO: 6288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacagctggcggcttggattggttattgg

SEQ ID NO: 6289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacatatgcagatgtccgcgtgtgaagac

SEQ ID NO: 6290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaccactccttacttgacgtttgatatgc

SEQ ID NO: 6291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacccagactgttctataattgtttaggg

SEQ ID NO: 6292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacccggcacgctagggattcgtcagcgg

SEQ ID NO: 6293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacctaatacggcttttacactcggtggc

SEQ ID NO: 6294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacctacccagtaacatggaatcgtgtgt

SEQ ID NO: 6295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacctatgtgcccataaacacctttaatc

SEQ ID NO: 6296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacctcactagcatgaatttctgggtaca

SEQ ID NO: 6297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgacgttgacctgttaggcacttgtcctgg

SEQ ID NO: 6298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgactcgcttggacccggacttcaggtttt

SEQ ID NO: 6299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgactgccttaaggagaaattatttctcgt

SEQ ID NO: 6300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagaactaagcgtggtctcaatgtggtgt

SEQ ID NO: 6301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagagtttatgactggaggagaaggcggg

SEQ ID NO: 6302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagatctggacagacagacgtggggtggt

SEQ ID NO: 6303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagatgtgagggtaggaggaggcccgacc

SEQ ID NO: 6304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagccctgcaaaccactaggtgcccatgg

SEQ ID NO: 6305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagcgcggagtcctaggtagtgtggtatt

SEQ ID NO: 6306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagcggccactttaccatcgtctgcggtc

SEQ ID NO: 6307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagcgtacgttagagatgcgtgcggaatg

SEQ ID NO: 6308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaggccaaccaacgtgggggtatatcagc

SEQ ID NO: 6309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaggcgtaagtttcgacacagcttgcaca

SEQ ID NO: 6310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagggagtctcttatcgggcgttatcggg

SEQ ID NO: 6311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgaggtactactagctcgacagacactgga

SEQ ID NO: 6312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagtaaagtatccgctggaagggacttgg

SEQ ID NO: 6313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagtgacatctaccccgcggccacgattt

SEQ ID NO: 6314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgagttgtccactttcacgtgcgtccacga

SEQ ID NO: 6315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgataaagtcgtcacgttgaactcttcccg

SEQ ID NO: 6316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatactacagtccggtcatcgacttcgga

SEQ ID NO: 6317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatagctgtaacctactacgatctttccc

SEQ ID NO: 6318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatatgacggtcctctgaaactcgttgaa

SEQ ID NO: 6319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatcaatacttatgcacgtatagtcacgc

SEQ ID NO: 6320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatccgggctgcatgacttgtcctccgtg

SEQ ID NO: 6321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatccttacgtcgtcgcagtttatggaaa

SEQ ID NO: 6322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatcgatcctagtgcgtaactgccgagag

SEQ ID NO: 6323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatctaggcgaagagggaccttttttgtc

SEQ ID NO: 6324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatcttgaaacacctctcgggccctacta

SEQ ID NO: 6325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatgaactagttcccaccctaggagctgt

SEQ ID NO: 6326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatgacgcgaccatgtgatcccgtgccgg

SEQ ID NO: 6327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatgccgaccaggcgacctttggagatcc

SEQ ID NO: 6328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatgcgaacttcgtcttgttatgtgttta

SEQ ID NO: 6329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatgcggcgcggtggcccagggtagctgt

SEQ ID NO: 6330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatggcacatcaccccgcgaggcttcgac

SEQ ID NO: 6331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgattcattactcgcccatagcctaccagt

SEQ ID NO: 6332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgattcgatctcagacggtcgtcgtttgcg

SEQ ID NO: 6333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgattcgttagtttacacttatagatctcc

SEQ ID NO: 6334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgatttgaagttaccgatcgagatacaggc

SEQ ID NO: 6335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcaacggacttcacatcgcgggctgttgt

SEQ ID NO: 6336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcacaacgtccgatcgtcctcagtctcgg

SEQ ID NO: 6337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcacaagcacagtgacttcggtctgacac

SEQ ID NO: 6338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcacatgtgttttccatctggaaataatg

SEQ ID NO: 6339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcaccgatttcgcgcattccgtgatacgt

SEQ ID NO: 6340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcacgcctgtgcgattgttcagtcaggtg

SEQ ID NO: 6341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcacgcgggtcacaacatccccgattagg

SEQ ID NO: 6342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcactttctacgtcgttagctgcatccaa

SEQ ID NO: 6343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcagccaggacttaatgataagttttgcc

SEQ ID NO: 6344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcagtaaacgctagggtcggccggtgcgt

SEQ ID NO: 6345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcattacctcatcatgcagcgcggtcccc

SEQ ID NO: 6346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcattcagagaaaaagatcggtagggagg

SEQ ID NO: 6347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcattttgaaacaacgtcgttaagagggt

SEQ ID NO: 6348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccaaatccctgagataagctctttatag

SEQ ID NO: 6349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccaataaggtccccagacgcttaactga

SEQ ID NO: 6350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccacacgttcagttgggagtggtcgggc

SEQ ID NO: 6351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccagcgggcacaggctcgtcggacatac

SEQ ID NO: 6352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccaggcgagggcaaactgtcagaagggc

SEQ ID NO: 6353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccccactagcggacgcggtttggttgaa

SEQ ID NO: 6354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccgaaggaggacaactggaatggtcacc

SEQ ID NO: 6355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccgctagggcaggcaccgttcgagtcat

SEQ ID NO: 6356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccgggaatagttacgtgccgtgatcgtt

SEQ ID NO: 6357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccgtcaatgaactcgaaaaggtagcaac

SEQ ID NO: 6358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcctacaggtttccggtgaagcgacgagt

SEQ ID NO: 6359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcctcacctacttctccaaggcggcggcg

SEQ ID NO: 6360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcctcagtgaagtttctgttcagcacctg

SEQ ID NO: 6361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcctcatgccctagaatgctcagcgtggt

SEQ ID NO: 6362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcctcctggaggtgactgagttgggcgcc

SEQ ID NO: 6363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgccttccaaccagtttgtttgtaggccga

SEQ ID NO: 6364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgaacggcagctgtgtatgttttgtgcc

SEQ ID NO: 6365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgaaggcggttctacaagccgtgccgtc

SEQ ID NO: 6366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgaataccatctccatcttggggacact

SEQ ID NO: 6367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgaatatcgagatgtgtgggtgttggta

SEQ ID NO: 6368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgaggcaatcactgtaaccaaagtttct

SEQ ID NO: 6369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgcaatggatgcctcacgtacccgcccc

SEQ ID NO: 6370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgcagcgtgcgcctattagttagcgcgg

SEQ ID NO: 6371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgccttcacgtcgacgttgggaagttac

SEQ ID NO: 6372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgcgcgatgaacagcagagggacgtccg

SEQ ID NO: 6373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgcgggtttcctctccaaaggctgttac

SEQ ID NO: 6374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgctgcgggtcgtgtgcaacgattctca

SEQ ID NO: 6375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgggacaacagcctcttccgggtaggcg

SEQ ID NO: 6376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgggggcccagcgcaggcagtgcaacga

SEQ ID NO: 6377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgtactgagtcctggccaacggatgtgg

SEQ ID NO: 6378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgtgaaggaacatcctgatcagcccacg

SEQ ID NO: 6379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgtgactaatcggggacgtaatggcggg

SEQ ID NO: 6380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgttcggtaaatgtacgccgagttgcgc

SEQ ID NO: 6381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcgttggatgctgttatgagagcttaggg

SEQ ID NO: 6382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctacaaatcacttcctgccccctgcgca

SEQ ID NO: 6383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctacagtgcgactcgggccccgtggttg

SEQ ID NO: 6384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctcattacgagcctggcgcataaacaca

SEQ ID NO: 6385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctcctcagtgtataattcaatcagagtg

SEQ ID NO: 6386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctgacatcggcaactcgggtcggccttg

SEQ ID NO: 6387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctgaccgaggattcgccagaccttcgta

SEQ ID NO: 6388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctgcattactggcgccttgctcacgact

SEQ ID NO: 6389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctgctaaactatcaagaacaagaggccg

SEQ ID NO: 6390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctggggacacgataaatgcctcgtcact

SEQ ID NO: 6391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcttagctccgggtcggccttcaacgctc

SEQ ID NO: 6392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcttgggcccttttcgtcactgagcgcca

SEQ ID NO: 6393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcttggtcacgcttctctacatcgctttc

SEQ ID NO: 6394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgcttgtaatctcgtggggtgtttatctgt

SEQ ID NO: 6395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgctttgaaaggggcgtgtcacgttggact

SEQ ID NO: 6396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggaacgtcaacgatagacgcttttgtcga

SEQ ID NO: 6397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggacacctcacgggatcgcgcgcggatgg

SEQ ID NO: 6398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggacagcatcactgatgaggcatgtaggc

SEQ ID NO: 6399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggactcctggacatgagggctttttgaag

SEQ ID NO: 6400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggactgcatgtattttcacttgtcaagtg

SEQ ID NO: 6401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggagggattttcgcccattcgccggagtt

SEQ ID NO: 6402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggattgattcatgattgtagcgacgggac

SEQ ID NO: 6403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcaaacccaccaactcgctgtgcgggga

SEQ ID NO: 6404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcactggtcattacgtgcatggaggagc

SEQ ID NO: 6405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcatacctccacccccaacggtactcgt

SEQ ID NO: 6406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcatcgtacggacgtcgttaccaggatt

SEQ ID NO: 6407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcatttacgatcggttagccagcggatg

SEQ ID NO: 6408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggccagggtcaaggtgaatgcgacttttt

SEQ ID NO: 6409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggccgcccacaacaatgtgatcagacccg

SEQ ID NO: 6410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcctaccggggcattagcctagtcgtgg

SEQ ID NO: 6411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcctgcgcgggtcagggatgcatggggg

SEQ ID NO: 6412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcgagtggaggaggttgagtgacggttt

SEQ ID NO: 6413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcgatatagtatatcgaagtggttggtg

SEQ ID NO: 6414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcgccgcccagcagctgaatggctcaac

SEQ ID NO: 6415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcgctcgaatgtcttggctgcgatttct

SEQ ID NO: 6416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcgcttaattactccggtttggtgggtt

SEQ ID NO: 6417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcgggtagctccactggcctcggacgta

SEQ ID NO: 6418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggctcccgttgcacacccatcgcccacga

SEQ ID NO: 6419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggctgccgttcgaactcttagctctttcg

SEQ ID NO: 6420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggctgccttagggccttggtggcgtgcgg

SEQ ID NO: 6421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggcttgtcgaggtccaggcactgcgctgg

SEQ ID NO: 6422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggaaataccggacgggtgacaccccctg

SEQ ID NO: 6423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggaaattaattcgtgtcaggctcggcct

SEQ ID NO: 6424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggacaacgccgctatgggtttgggttga

SEQ ID NO: 6425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggacccgtcatgagcgcatgtgtgactg

SEQ ID NO: 6426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggatggacgggacgcatcgacatcttcc

SEQ ID NO: 6427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggcatcgactaacgcaaccgacggctgg

SEQ ID NO: 6428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggccacacgacataagcgcgccgggcga

SEQ ID NO: 6429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggcgacctgatgaggaactgttggcacg

SEQ ID NO: 6430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggcgtaaggccaagtggaaaaagttgca

SEQ ID NO: 6431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggctctctctcggccacgccaacaactc

SEQ ID NO: 6432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggctgtgaatattttaagcgcattaggt

SEQ ID NO: 6433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggctttgttatgtggttgcaatcatatt

SEQ ID NO: 6434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggaatccccgctcgtgttgtttgggcc

SEQ ID NO: 6435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggacacgcgtaaacggagcaacaatcc

SEQ ID NO: 6436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggcactaacttgtatttattagaaccc

SEQ ID NO: 6437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggccgagccgaaaagttccaggatgct

SEQ ID NO: 6438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggccgctagacagtccacgatcctatc

SEQ ID NO: 6439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggctggttacgtcgtgggggtaagcgg

SEQ ID NO: 6440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggggatattggtagccttccgcatcaaa

SEQ ID NO: 6441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggggtcagggaatttctaactcgacagc

SEQ ID NO: 6442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggtctgcttacttctgaacgacggcta

SEQ ID NO: 6443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggggttctcagccatgtacgttgtttacg

SEQ ID NO: 6444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggtaggcgtagacgttgcttgtggtggc

SEQ ID NO: 6445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggtagggtagttaggggagtgacgaagg

SEQ ID NO: 6446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgggtggctagggtattgcagcacacggga

SEQ ID NO: 6447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtagaaggcggacaggacaggccatatc

SEQ ID NO: 6448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtcaacccttcgcacgtcttaatcgatc

SEQ ID NO: 6449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtcagtaccaagtgcaagtttcgggcaa

SEQ ID NO: 6450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtccgtctctacaggagccatattatca

SEQ ID NO: 6451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtctcgaggggcactcagagatcgcccg

SEQ ID NO: 6452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtgagcagaactatcctaacgatattgt

SEQ ID NO: 6453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtggggtctatactccggagggtcggat

SEQ ID NO: 6454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtgtggagggtctgcctgcgtttgtgtt

SEQ ID NO: 6455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggttaggttatggcgcaattagtgtgggc

SEQ ID NO: 6456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggttattcgagtggtctccagaaattgtt

SEQ ID NO: 6457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggttcaacaagtcggatgcgtcatcttat

SEQ ID NO: 6458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggttcatatccatccaattccacggcaac

SEQ ID NO: 6459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggttgcgaaaccactttgacgagcgataa

SEQ ID NO: 6460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtttgtaagagaaaaacactaccgcagg

SEQ ID NO: 6461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggttttccacaaggtagcgtccagttggg

SEQ ID NO: 6462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actggtttttcacccataggtgatacggtttt

SEQ ID NO: 6463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtaaaccggctgcattccatgtcgaattt

SEQ ID NO: 6464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtaagaccctttactcttgtgtagcaggc

SEQ ID NO: 6465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtaaggcattgaagaacgacatggagtgc

SEQ ID NO: 6466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtaatcgaaatcagccgcccagccatggg

SEQ ID NO: 6467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtacatgattcatgcctttaccgtaactg

SEQ ID NO: 6468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtacccctcagcgcgataactatccctgc

SEQ ID NO: 6469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtactcatgagacctacgctacatccccg

SEQ ID NO: 6470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtaggggttgtcggaggcttgcttacagt

SEQ ID NO: 6471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtaggtccgcataaggtaagcaatggtgg

SEQ ID NO: 6472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtaggtcgccgcccccacgttcgctaacc

SEQ ID NO: 6473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtatcaacgttaagcaaaatccgggggat

SEQ ID NO: 6474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtatgcgggaggatgcaagagatcgtctg

SEQ ID NO: 6475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcaatcggggctcattcccacgctggcg

SEQ ID NO: 6476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcaatgccgtacccatcgatagactgta

SEQ ID NO: 6477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcacgtgcacgcggaagaggcttccggg

SEQ ID NO: 6478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcaggtagatgaatgctcaggatcttcc

SEQ ID NO: 6479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtccaagatccagtaaaacaccgatgatg

SEQ ID NO: 6480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtccacgggcgtccagtttaatcacgtca

SEQ ID NO: 6481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcccagcgcaaacgctattgggcattga

SEQ ID NO: 6482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcccttgccgtatagcgtccccgcttgg

SEQ ID NO: 6483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtccgattacccatagtgcggggtcgctg

SEQ ID NO: 6484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtccggcatttcagtgtgctgttagtagg

SEQ ID NO: 6485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtccgtagctttccactatcagacgcgcg

SEQ ID NO: 6486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcgcccattggacccgactagcgaggcg

SEQ ID NO: 6487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcgctagtgaatgatcttcgggacacgc

SEQ ID NO: 6488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcggcgcctctaaacttcagttgttggg

SEQ ID NO: 6489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtctctacctaagattctggccggtacgc

SEQ ID NO: 6490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtcttcagggattgagaactttggttgcc

SEQ ID NO: 6491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtctttggagggatgttttccggttatcc

SEQ ID NO: 6492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgaatctgcaattaatatgtggggatcc

SEQ ID NO: 6493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgatacttcggactatggtaaatgctgt

SEQ ID NO: 6494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgatccgtgtcgaacttcgtttatgccg

SEQ ID NO: 6495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgatggaggctactacctaaacatggcg

SEQ ID NO: 6496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgcagtggaggtattgtttcagcctgtt

SEQ ID NO: 6497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgccactgtcaagttttttcggcgggag

SEQ ID NO: 6498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgccctacgattccgttcaccaatagct

SEQ ID NO: 6499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgccgcaggcaatcctccatcttccctt

SEQ ID NO: 6500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtggaacacggggtgattgacgggcaggg

SEQ ID NO: 6501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtggccaccctttttaaaggccccaagca

SEQ ID NO: 6502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgggcaccattaatatggtgagaggtac

SEQ ID NO: 6503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgggcgatagtgcttcggagcatgctgg

SEQ ID NO: 6504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgggctgtagatgctgtgtgtccgatca

SEQ ID NO: 6505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgtcgcgcgtttaaaggtagctactgtg

SEQ ID NO: 6506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgtcggcctcactatttgccgtcgcacg

SEQ ID NO: 6507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgtcgggcttccgaatgattggtttagg

SEQ ID NO: 6508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgtgcgtcatacccgaccgtggatacgg

SEQ ID NO: 6509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtgttatgtgtttgcgacttgggcctagg

SEQ ID NO: 6510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttatggcccgttgcttgtttgcgttgtg

SEQ ID NO: 6511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttcacggggttagaggtttaataaaaac

SEQ ID NO: 6512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttcagccacgtaggttaatctggtttgc

SEQ ID NO: 6513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttcgtaagcgcgtgtgcgggggcaaagg

SEQ ID NO: 6514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttcgtggtatcccgttgccaggtttgct

SEQ ID NO: 6515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttctccacctcgattacaccggaagaga

SEQ ID NO: 6516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttctgatattcgtgcacggtatagcgcc

SEQ ID NO: 6517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttgccggagtcgattgcactattctgcc

SEQ ID NO: 6518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttgcgatgcgctcgggtttggtaccacc

SEQ ID NO: 6519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttggtggcttgtcctctggatctaccga

SEQ ID NO: 6520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgttggtttggtactggcagagtcgacttc

SEQ ID NO: 6521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtttaccggtggggttggtgccgtgcgct

SEQ ID NO: 6522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtttcaggtcccgcgagaacttttgtaga

SEQ ID NO: 6523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtttgcctggccaagcaatctcgtttcac

SEQ ID NO: 6524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actgtttgggtttagagtatacggggcggcct

SEQ ID NO: 6525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaaaagcgtatgggttcaatcttagccgg

SEQ ID NO: 6526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaaaatggccgcaaccgctacactcgggg

SEQ ID NO: 6527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaaaggcataaatcgacactgtggaaaag

SEQ ID NO: 6528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaaccgcatggagggtctctcctcgtgtg

SEQ ID NO: 6529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaatgcataagtccggtttcccgcctcca

SEQ ID NO: 6530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaatgtggggaccgttgacggccgcggtg

SEQ ID NO: 6531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaatgtgtcccgtactacccacgatgcat

SEQ ID NO: 6532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaattaacgcgcgttccaggctatcgcaa

SEQ ID NO: 6533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacacgcgtgcggggcatcggctttggta

SEQ ID NO: 6534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacatgctagttccttaccatccgtttca

SEQ ID NO: 6535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacatggctgtctgcgatcacaggtaatc

SEQ ID NO: 6536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacctaggttggaggcgcttaggtgtgtc

SEQ ID NO: 6537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacgagtgcgcccggtctaacggtttggc

SEQ ID NO: 6538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacgcaaacgttgaccttatccggtggag

SEQ ID NO: 6539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacgcagaaatccaggtctatgcgaacgc

SEQ ID NO: 6540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacgcccgcctgaccccattaacgtattt

SEQ ID NO: 6541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacgctgcgccgaggactagtcagagcgt

SEQ ID NO: 6542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacggcgagcagtttggtgggggccactg

SEQ ID NO: 6543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttacggggggcggcccttctattttaaccc

SEQ ID NO: 6544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttactgaaaaagcagtccttaggctcgctc

SEQ ID NO: 6545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttactgtaggtagatatgactcaatcttat

SEQ ID NO: 6546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttagagagaggtggtcgcaaggtattgctg

SEQ ID NO: 6547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttaggactagtgttatgctttatagatttg

SEQ ID NO: 6548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttagggcaagcgtcgcacttgtggggtgta

SEQ ID NO: 6549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttagtcttccctgtgtaccgctcgttccca

SEQ ID NO: 6550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttagtgcggttagtcacacacattacccgg

SEQ ID NO: 6551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttatccttttacttgggctattagtttcca

SEQ ID NO: 6552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttatctgaatcggctgtgcggtggatgggg

SEQ ID NO: 6553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttatgatggcaagatgtgtttcgggcatgt

SEQ ID NO: 6554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttatgcattacccgctttaggccgaacccg

SEQ ID NO: 6555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttatgggcttccatgatactaacccccgta

SEQ ID NO: 6556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttattcgacgaagtttttaaatcttaacgg

SEQ ID NO: 6557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttattgacaagtgctagacatgagagcttt

SEQ ID NO: 6558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcaaacgtaccatcaataaatggtgtgtg

SEQ ID NO: 6559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcaaaggagctggcatctcgctctttaac

SEQ ID NO: 6560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcaacccgtactctgggccaagaaagtca

SEQ ID NO: 6561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcaactcacttcttgccttacctgcttat

SEQ ID NO: 6562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcaatcggttatctcggtcctagttgtcg

SEQ ID NO: 6563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcaatgcctgatgaaacctgttcgatgtc

SEQ ID NO: 6564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcaccaacgggatctaatctggatgatgt

SEQ ID NO: 6565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcacctttgactccgaccatgttggctta

SEQ ID NO: 6566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcagcagttccgagccaccttggtagagc

SEQ ID NO: 6567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcagcgcagccgttaggttactcactaaa

SEQ ID NO: 6568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccacgcttttaacaccggccctcgaacg

SEQ ID NO: 6569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccatataaataaagttcgggtggattct

SEQ ID NO: 6570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccatcgcaggagaggggctgtttggaag

SEQ ID NO: 6571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccccggagttcttacagggtatattagt

SEQ ID NO: 6572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccgaccatggggtggactcggagggtgc

SEQ ID NO: 6573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccgacgcacatatacctcacaggttttt

SEQ ID NO: 6574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccgtgtatctgacagaggtgatcggggt

SEQ ID NO: 6575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcctggttgttcacgaagtttcccggtgt

SEQ ID NO: 6576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttccttgtccgcttctcagtctttgcccgg

SEQ ID NO: 6577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgacacgtgacccccggccctgccagta

SEQ ID NO: 6578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgaccagtattcactcggggacgctgta

SEQ ID NO: 6579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgatacagttggcatgctcaccggccgt

SEQ ID NO: 6580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgatatgtttcttcagggcgccaacttc

SEQ ID NO: 6581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgctgtaaggtgtgctgtgttcataatc

SEQ ID NO: 6582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgctgtaccgactatttggttcccattg

SEQ ID NO: 6583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcggacggttacatgtggtaagagtggcg

SEQ ID NO: 6584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcggagtctgcggtttcggcctgcaggct

SEQ ID NO: 6585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcggcgcgaatgaggccttacgagtctag

SEQ ID NO: 6586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcggcttgctccttgaggttttccaggtg

SEQ ID NO: 6587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgggcacgattatatgcactccgcgcct

SEQ ID NO: 6588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcggtctactcaggtcctaccttgggccg

SEQ ID NO: 6589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcggtggttcatgtgggctaaagtgactt

SEQ ID NO: 6590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgttctgatataggaagcttcgtgtcta

SEQ ID NO: 6591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcgttgacctgctctgaatctgtgggcgg

SEQ ID NO: 6592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctacacgaccaaggttagggttcgttga

SEQ ID NO: 6593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctcacaccggtttgtgactctgcgagct

SEQ ID NO: 6594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctcatgccaacacctcggacagcggtgg

SEQ ID NO: 6595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctcgaaagagcgtcggatacgcacggtt

SEQ ID NO: 6596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctgcttattgtggctgggtacagtcggc

SEQ ID NO: 6597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctgtcaacttgggttcctgcgaccgttg

SEQ ID NO: 6598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctgtgcggataacgccctctaggtagtt

SEQ ID NO: 6599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttctgttaagcctgcacgagtgggctggct

SEQ ID NO: 6600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttcttggccagcgtttcgtcgcgaatccgg

SEQ ID NO: 6601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgaacttcttggcagaattccagagggtc

SEQ ID NO: 6602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgaatccgagtccgctttggatgctcgct

SEQ ID NO: 6603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgacgaaatcgtccaacaggcgtgccacc

SEQ ID NO: 6604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgagagctatatcccccagcggcacggga

SEQ ID NO: 6605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgaggcttaaccggtcgaggagatactcg

SEQ ID NO: 6606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgagggggctccacgcggttgtcccgctg

SEQ ID NO: 6607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgaggtgccgcacgttctgccgtctctat

SEQ ID NO: 6608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgagtgttacttgcctcggtcatcgctgc

SEQ ID NO: 6609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgatccggttgggattcagtttacccgtt

SEQ ID NO: 6610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgatctcacgtcgacgtccggacaaaccg

SEQ ID NO: 6611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcaataaccgcgctagtccgtaagcctg

SEQ ID NO: 6612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcactgagatctgcatcgtctagtttgc

SEQ ID NO: 6613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcagcaacacccttgataggcttacgac

SEQ ID NO: 6614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcagcagtggtgtatggcatgtttggaa

SEQ ID NO: 6615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcatcaagatagcggttcccagcctaag

SEQ ID NO: 6616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcatcaaggatcaggcccgctcacgttg

SEQ ID NO: 6617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcattagattcgccgggccgcgacaccg

SEQ ID NO: 6618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgccagctactcgcctagtacaagagggc

SEQ ID NO: 6619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgccatcttaatagccttagcctgccggg

SEQ ID NO: 6620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgccatttaaggaggagctcatcgcaagg

SEQ ID NO: 6621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgccggctcgacgatcctctgttttgtgg

SEQ ID NO: 6622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcggctcacgtatgtcactcgatttggc

SEQ ID NO: 6623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgcgggagaacccaatacttgacgattaa

SEQ ID NO: 6624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgctcgcctgcgccggacacgagtgttcg

SEQ ID NO: 6625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggaagtaaatatcggcaagaagggtatt

SEQ ID NO: 6626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggacacagggtagttattacggccagtg

SEQ ID NO: 6627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggagagttccgacggctgtctagggcta

SEQ ID NO: 6628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggagcacccagctgttttcaccggacta

SEQ ID NO: 6629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggagcggtcattgtattgagtgctcacg

SEQ ID NO: 6630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggccgcccttacatagccctcctttgcc

SEQ ID NO: 6631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggccggcacgcatcaccctctctagctg

SEQ ID NO: 6632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggcgccgggtggactctgttgagcgctg

SEQ ID NO: 6633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgggacatctggcataggcttgcgacgtg

SEQ ID NO: 6634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgggagcgtccacttactctctcctcgct

SEQ ID NO: 6635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgggaggtgcgggaggaagtcagtcacga

SEQ ID NO: 6636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgggccggcccttgcgctgcactgtctgg

SEQ ID NO: 6637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgggccggtccaacgcagcttgtgccatt

SEQ ID NO: 6638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggggagggcgatccgggcgtcacagccg

SEQ ID NO: 6639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggggattgtgtccgttatatcacctggg

SEQ ID NO: 6640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgggtctgttaccgacggcactgttattc

SEQ ID NO: 6641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgggtgcgattacattcatacgatcggtg

SEQ ID NO: 6642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggtaaaggtagccactccactgatcagg

SEQ ID NO: 6643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggtcttcaaggcgatcgtctcgtgcagt

SEQ ID NO: 6644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggtggagagtttgcgggcgttatactgt

SEQ ID NO: 6645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggtggtgtcttgtgatagagtcgtgagt

SEQ ID NO: 6646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggtgttcagtacgtccaatccgctcacg

SEQ ID NO: 6647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggttcaaagattcggtcttaagttcctt

SEQ ID NO: 6648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggttcctccatcttagccatcttactgc

SEQ ID NO: 6649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttggtttggacgaccagcgacgcgatagtt

SEQ ID NO: 6650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtaactcacgtgacatccatctctggta

SEQ ID NO: 6651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtaattacgaacgttgtttctaattagg

SEQ ID NO: 6652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtatgttctgtcatatctggttgtcata

SEQ ID NO: 6653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtattaatgcctggtccgacggaacgct

SEQ ID NO: 6654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtcagctgtcaccccagccatgtaacgg

SEQ ID NO: 6655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtcagggggaaaatgcaccttacatcgt

SEQ ID NO: 6656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtcattctgacgcccttaatcaaagcgc

SEQ ID NO: 6657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtcctatacaaaagttagtcgactccgt

SEQ ID NO: 6658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtcggtagaggtcctagttcattatgtc

SEQ ID NO: 6659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtctcgaaggggcgtatgcttgcggccg

SEQ ID NO: 6660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtctggcctcgaggaccagtgggattcg

SEQ ID NO: 6661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtgatggatgtgacattatactgccgtg

SEQ ID NO: 6662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtgcggaggattgaacgacgaacgcccg

SEQ ID NO: 6663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtgcttgtcccaggcagtttgttcctta

SEQ ID NO: 6664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtggattcaaatgcaagtgtatgtacgg

SEQ ID NO: 6665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtggtccgttcaccttgctgaatccttc

SEQ ID NO: 6666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtggtctaatgtgtttcagatttacaat

SEQ ID NO: 6667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtggttgtagggtgtttactggggttgt

SEQ ID NO: 6668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtgtggcttcaaggcgtagacactgact

SEQ ID NO: 6669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgttacgctcgactagaggctgtttacgg

SEQ ID NO: 6670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgttaggccgccactcgagattgttgttc

SEQ ID NO: 6671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgttatttcccctcttttgaccgcgcgtg

SEQ ID NO: 6672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgttgggatccgtctgtaccggatgtgca

SEQ ID NO: 6673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttgtttttagttatccttgtagtgttcgga

SEQ ID NO: 6674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttaagcacgtacctccggcgatatatgga

SEQ ID NO: 6675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttacgaaccgtataatacagcttatccta

SEQ ID NO: 6676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttactgtaaggtataacgttcgactttta

SEQ ID NO: 6677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttaggatatgttggactggctgcggttct

SEQ ID NO: 6678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttagtgacgcgtgcgcaccgatttttgct

SEQ ID NO: 6679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttatatcgaatgacatcagtctgaggtaa

SEQ ID NO: 6680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttatctttcgccccattctcgcgttcggg

SEQ ID NO: 6681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcaaagcaaatcttgacgaagcggagta

SEQ ID NO: 6682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcaaccggtaccattttacgtacaccgg

SEQ ID NO: 6683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcaagtttgaactccgacaaagggtggt

SEQ ID NO: 6684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcatggcgcagttctaattcacgggaag

SEQ ID NO: 6685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttccactaactgtgtgcaggccacagcgt

SEQ ID NO: 6686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttccctaacatgttagaccgacttccggc

SEQ ID NO: 6687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttccctgccgctagatctcgtatctggtg

SEQ ID NO: 6688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcgaagcagtagtatttgatcgtgcctc

SEQ ID NO: 6689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcgaagtttcgtcgctaagttgctgttc

SEQ ID NO: 6690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcggaatctcggtcgcggaagcactcac

SEQ ID NO: 6691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcgtatgtatccggctatactgtcgcac

SEQ ID NO: 6692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcgttatcgatagctggcgttggaatag

SEQ ID NO: 6693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttcttaaaagtggctatggcactagtcgg

SEQ ID NO: 6694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgaacgtacgtgtctcctgttcatagta

SEQ ID NO: 6695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgaagtctaacgtctgtacggtgttgcg

SEQ ID NO: 6696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgaagttcggtgaacgcgcggagcaagg

SEQ ID NO: 6697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgacactcaagtaccgcctagctagctc

SEQ ID NO: 6698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgacatattcgggatgcagcatgtcgat

SEQ ID NO: 6699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgacgcgtgtttgatagagccgggagca

SEQ ID NO: 6700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgatattccggttactgaggttcggaag

SEQ ID NO: 6701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgatcactccgccacaaggaacacattt

SEQ ID NO: 6702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgattgtttttgtaattgtacatgggtg

SEQ ID NO: 6703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgccaagtttagtacggtcccagatcta

SEQ ID NO: 6704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgcctctttcctgcataccggggtcgtg

SEQ ID NO: 6705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgcgattcacggagattcccggtcgtgc

SEQ ID NO: 6706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgcgtataacatgcatctatcctgtacc

SEQ ID NO: 6707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgctatccctctgatgtctgttttggcg

SEQ ID NO: 6708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttggcgctggagtcgcgtgattattccct

SEQ ID NO: 6709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttggcgtatcgggatggagctcacggagg

SEQ ID NO: 6710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgggactgaaaagtgttcgaacttggcc

SEQ ID NO: 6711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttggtcgtccaattcaccatttgggtcat

SEQ ID NO: 6712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgtcaatatagcgctcctccgtgtttcg

SEQ ID NO: 6713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgtgtggtacagtctggcgagtggaccg

SEQ ID NO: 6714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgttaatctgcttgcacgcaacacctcc

SEQ ID NO: 6715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
actttgttgtactgcctagcataggccaagaa

SEQ ID NO: 6716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttacggttctaaattcccaaaagcgcaa

SEQ ID NO: 6717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttaggcaaatgtctgcaagcccccacag

SEQ ID NO: 6718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttaggctcggcggaaccttaaatgcatg

SEQ ID NO: 6719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttatatcaccattcagctcgcacgcgtg

SEQ ID NO: 6720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttatcgcctatatgtttgttcaccgcga

SEQ ID NO: 6721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttatgcgcattagcgtagtttccagttg

SEQ ID NO: 6722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttattggatctgtcacgagaaaacgccg

SEQ ID NO: 6723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttcaatgcctgtgttgtgatgaacgtag

SEQ ID NO: 6724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttccccactgcaccataggttctgacat

SEQ ID NO: 6725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttctgcaccagggtttgccttaaacttt

SEQ ID NO: 6726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttgcacgttgtacgggactcggaacacg

SEQ ID NO: 6727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttgtaacatacgcccctaagatgatgca

SEQ ID NO: 6728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttgtcactacaatcttcggtttagtggg

SEQ ID NO: 6729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
acttttttcagtccccgtttgtgagtgaaggt

SEQ ID NO: 6730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaaagacgtattcttgtcaaacccctgcc

SEQ ID NO: 6731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaaaggttcttaggtaggcgctcatccga

SEQ ID NO: 6732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaaagtaacgacgcattctcgatattaat

SEQ ID NO: 6733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaacaccgtcgtattgagttctaaacttc

SEQ ID NO: 6734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaacgcaaagatgaaacatccgttttgcg

SEQ ID NO: 6735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaattgtcttgcgtgttccaggagacagc

SEQ ID NO: 6736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaccctatccccacagttccgttttctcc

SEQ ID NO: 6737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaagaacttgccctttatggagcatgctcg

SEQ ID NO: 6738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaagaatgcctatccccccggatatcttag

SEQ ID NO: 6739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaagagaccgtgttcttgggtaacgacagg

SEQ ID NO: 6740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaagcgctagtcagccactaccaggcgcgg

SEQ ID NO: 6741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaagcgtgttacccggtgatctagcttgcg

SEQ ID NO: 6742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaagcttaccggtgcaatgcttatattgga

SEQ ID NO: 6743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaggcaggggtaagctccacacacaagat

SEQ ID NO: 6744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaggcgctacccggtctcatgttcacggc

SEQ ID NO: 6745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaaggtgatactaggcgtaaacggagcccc

SEQ ID NO: 6746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaatccttgtttgtcagtcgcatctccgta

SEQ ID NO: 6747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaatgccacattagggatatagtttcagtt

SEQ ID NO: 6748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaattgtcagtatggatttgagcccacgtg

SEQ ID NO: 6749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaatttcccgaggtacgggtattagtctct

SEQ ID NO: 6750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaatttgggctatgccaggcgtacactaca

SEQ ID NO: 6751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacagggatagtctatcccaagggaatcgc

SEQ ID NO: 6752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccacgctgggatcgcggtacccgccctg

SEQ ID NO: 6753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccacggcccgggatcatcgagttcgctg

SEQ ID NO: 6754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccagtccgtgtgttagcgacctctcgcg

SEQ ID NO: 6755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacccaaacatgcccagtaacttctctgat

SEQ ID NO: 6756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccccggatatggcttcacgtacttaacg

SEQ ID NO: 6757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacccgcgaattcatctcgatgagcattcg

SEQ ID NO: 6758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacccggagggacacacgtgtcggaatggt

SEQ ID NO: 6759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacccggtgcaattgggcatatttgcggtg

SEQ ID NO: 6760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccctaatagacattaaattgggcggatg

SEQ ID NO: 6761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccgcgagtagcttcctaacggtaccagc

SEQ ID NO: 6762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccgcgcgtacactgaatccttctgttgg

SEQ ID NO: 6763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccgcgcttcactctgccgagggcgttcg

SEQ ID NO: 6764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccgctgataactgaggtcaagcttgtgg

SEQ ID NO: 6765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccgtatggctacggtgcttcctcatgtc

SEQ ID NO: 6766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaccgtggtcgcatgcggtctcggattttg

SEQ ID NO: 6767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacctattgcagggagggatgggggaagcg

SEQ ID NO: 6768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgagactggcaccaaccctgggacatgt

SEQ ID NO: 6769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgccccgatagagggtggaggctaggtg

SEQ ID NO: 6770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgcctcgattatctagtctaatatcctt

SEQ ID NO: 6771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgcctggacacctgcgcctgcccagccc

SEQ ID NO: 6772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgcgcacgaaaggatgagattgtgacat

SEQ ID NO: 6773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgcgggagagagattgtgtcgtgctggc

SEQ ID NO: 6774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgcgtgcgaacagacgacagcacaattc

SEQ ID NO: 6775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacggatcagggttgttctgactccttcga

SEQ ID NO: 6776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgggtccggctcaaagtgcactgtgctc

SEQ ID NO: 6777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacggtcttgggcccacacttttcgaatga

SEQ ID NO: 6778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgtcagtgccctttcttcggacactgga

SEQ ID NO: 6779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaacgtgtgggatggtccttctcagtatgcg

SEQ ID NO: 6780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaactaacaacgtgacagcgagtcctaccca

SEQ ID NO: 6781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaactccaagtagacatattaatagaaatgg

SEQ ID NO: 6782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaactgggttagagttacagtgcacatccta

SEQ ID NO: 6783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagaagtgctaacgcagaacaccaacaagg

SEQ ID NO: 6784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagacagtttgtatctggtgctttttgctc

SEQ ID NO: 6785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagacctcagaatcctggtgtctgccatgt

SEQ ID NO: 6786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagacgccggacaactcgatcggcaggagg

SEQ ID NO: 6787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagacgcggttctgggcatcatcacgccgc

SEQ ID NO: 6788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagagcatttggtgtaacgcagtcatctcc

SEQ ID NO: 6789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagagcgaaccgaagcagcgacctctggtg

SEQ ID NO: 6790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagaggagtcttctagcagaacccctggcg

SEQ ID NO: 6791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagagggagccgtgactcatggttcgctga

SEQ ID NO: 6792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagaggtaattgtagcgaagattgctggtg

SEQ ID NO: 6793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagaggtgctctcgtacatgaactgcgctt

SEQ ID NO: 6794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagcaccttaatgtaagttaggccaccttt

SEQ ID NO: 6795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagcagtctcgaggacgtgtgacttgacac

SEQ ID NO: 6796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagcccctcaagtgcacaacgtccccacga

SEQ ID NO: 6797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagcgccacaactcgcctttccgaaaatgc

SEQ ID NO: 6798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagcgtggttaaccgtgtaatacgacgacg

SEQ ID NO: 6799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagctcgggctgccgtaggtataccaatgt

SEQ ID NO: 6800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagctgcgcacgttatctgtgcggcgcatc

SEQ ID NO: 6801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggaaatacggggtgtattccgctggtcg

SEQ ID NO: 6802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggacttgccagcaaggtctcacaggtgg

SEQ ID NO: 6803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggcaccgtcccgaggtattagtcttgca

SEQ ID NO: 6804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggcgaggaggagggcagttaagtcctta

SEQ ID NO: 6805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggcgtactatgctcgcaccgaggatacg

SEQ ID NO: 6806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggctaagcctcaccccaaacgatgtgct

SEQ ID NO: 6807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagggcagatctatagttaataatcaagtg

SEQ ID NO: 6808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagggtaccgttgtgcggtgttgcaagtta

SEQ ID NO: 6809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggtcctatgctgtgtaccagctgtgagc

SEQ ID NO: 6810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaaggtggcggcccatccgcatcgaacatgc

SEQ ID NO: 6811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagtaattgctgcggcgacataccgtcatt

SEQ ID NO: 6812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagtagcgtgcccgttacagcgtccgcgat

SEQ ID NO: 6813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagtatcgcacataaccctcaccctagatg

SEQ ID NO: 6814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagtcggaagaactcgcgcgtaaccggagg

SEQ ID NO: 6815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagtcggaaggtgcacataggcgtgcatct

SEQ ID NO: 6816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagttattcaggactgttttaggacacgca

SEQ ID NO: 6817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagttccgcggtccgttaggagtccacctc

SEQ ID NO: 6818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaagtttctggatcataatgctagtagcgat

SEQ ID NO: 6819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaataacgaggttatgtggcttagagaaggt

SEQ ID NO: 6820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaataaggtgacagatgggtcagtcatctct

SEQ ID NO: 6821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatactaacggacaacctttgctgggagtt

SEQ ID NO: 6822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatattctgggatgagagtttagtacttcg

SEQ ID NO: 6823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatcaaggtcttcgtgtacactaatttcca

SEQ ID NO: 6824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatcaatttcgaggagtagagacctgtttg

SEQ ID NO: 6825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatcagttcagagtgcccgaattgggacgt

SEQ ID NO: 6826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatccagcggccagcgacggagatcgaccc

SEQ ID NO: 6827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatccgctcaggttgctcgtcgcttcacct

SEQ ID NO: 6828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatcctccctgttcgcgtccctttgttcgg

SEQ ID NO: 6829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatcgaggcatttcttcttggttagttgtc

SEQ ID NO: 6830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatcgcgtgacaaacaggcccggagtgccg

SEQ ID NO: 6831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatgcgggtatgctatcgtgcccttctcgg

SEQ ID NO: 6832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatgctcctagcttgagtggctattgatgg

SEQ ID NO: 6833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatggcccgatgtcatcctcaagcactcaa

SEQ ID NO: 6834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaattagtggatttcgggaatcactatgaga

SEQ ID NO: 6835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaattgaagtttgggagagagcgggtcgcgg

SEQ ID NO: 6836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaattgcgtgatatgcttacactagcgctgg

SEQ ID NO: 6837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaattgtgacgtcagtaggggcatgtctggc

SEQ ID NO: 6838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaattgtgtgctctcgtaatcgctggcaggg

SEQ ID NO: 6839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaatttgctttcatgagtgctacagtcatcc

SEQ ID NO: 6840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaattttaaggagttgtaggtcggtaacgtt

SEQ ID NO: 6841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaattttattgtcataggattcacttcgcta

SEQ ID NO: 6842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaaacgccccgcagcttaagcttccggtt

SEQ ID NO: 6843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaaagcggtcggttaaaattctcgtcctc

SEQ ID NO: 6844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaacccccagcaccgtgatgtacgatatg

SEQ ID NO: 6845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaaccgctcacagtgctttatgctgtgtg

SEQ ID NO: 6846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaagcatcatagaggatgtaaggaaatat

SEQ ID NO: 6847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaagtgctgtttacatacctaagcccgta

SEQ ID NO: 6848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaatacataggtgactgtaggttacggag

SEQ ID NO: 6849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaatagtacattgtaaagttgtgcgtccc

SEQ ID NO: 6850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaatggtgtggaacgtggtgggcttgggg

SEQ ID NO: 6851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaattttcttgggcgtattcaatgccctg

SEQ ID NO: 6852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacacaggagcgtggacctcttgccggttct

SEQ ID NO: 6853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacacatattcagcctccacgatgaggaacc

SEQ ID NO: 6854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaccagcgttcgtcatgccgggccttcaa

SEQ ID NO: 6855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaccgtgcgaaccatggtgaagggacgta

SEQ ID NO: 6856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacacctgccgcatactgacccgtcttttct

SEQ ID NO: 6857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacacgaagcaagaaaagtctcggggcagct

SEQ ID NO: 6858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacacgcagtcccggcgcataagcgatggta

SEQ ID NO: 6859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacacgtcctgttattgacccttcttgctac

SEQ ID NO: 6860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacactcgcgtccacatttgttttcattgtg

SEQ ID NO: 6861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagaaacaggttcgccgagtagcatgtac

SEQ ID NO: 6862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagaagcagtatgttttctttttttgtcc

SEQ ID NO: 6863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagacagtgaaccttgacaggcacccagg

SEQ ID NO: 6864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagaggacacaaaaagctaaacttgcgtg

SEQ ID NO: 6865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagattagggcactggtccatgcatagcc

SEQ ID NO: 6866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagattccgtccagggcaggatgctcact

SEQ ID NO: 6867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagcactaatgttttcgtatggccccgag

SEQ ID NO: 6868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagcggatggagcctcgtgcgggtagtgc

SEQ ID NO: 6869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagcgtttgctccccctcccgtatctccg

SEQ ID NO: 6870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagctaacccttgttttggactctttttt

SEQ ID NO: 6871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacaggagacacttgggtactgtattcactg

SEQ ID NO: 6872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacagggctttccctcggttactcggcccca

SEQ ID NO: 6873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacataacgcgaggttggatatcagagtcgg

SEQ ID NO: 6874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatacagcgcgttcgggcagtccttgacg

SEQ ID NO: 6875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatactgcatcccccggctttatagtagg

SEQ ID NO: 6876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatagccagtgggtgtggccttgcgtcgg

SEQ ID NO: 6877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatatcttgcaccgccattaacgcggccg

SEQ ID NO: 6878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatatgccgctggatcaacctcagtgaac

SEQ ID NO: 6879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatcacgggggatttaatcactagcgggc

SEQ ID NO: 6880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatcatagacgcaggtttaagaatggatg

SEQ ID NO: 6881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatggaactgctcacaggtggcaatcgag

SEQ ID NO: 6882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatggctttacgtttaccacgataagtcc

SEQ ID NO: 6883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatgtcacagccgtctgatcgtgtatccc

SEQ ID NO: 6884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacatgttccattccaggcactactctctgg

SEQ ID NO: 6885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacattgtcgagcctgatcctctgcatcgtt

SEQ ID NO: 6886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacattgttgaatttactaggcattggtcac

SEQ ID NO: 6887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacattttcgtaagaccagtaagggtggccc

SEQ ID NO: 6888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccacagcaagcgctgctcgttgcgtcttc

SEQ ID NO: 6889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccacagcgtcacagatgtttgattatgtt

SEQ ID NO: 6890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccagcgactcttgtgattgtacacgcttg

SEQ ID NO: 6891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccagcttatcaaggttgcgttaattgtgc

SEQ ID NO: 6892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccagcttttcttgatagtctccatggttg

SEQ ID NO: 6893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccatccacgtggagttttatattaaggct

SEQ ID NO: 6894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccatgaattagcacttcgagggagagaaa

SEQ ID NO: 6895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccattatattctgccaatttctcgttttg

SEQ ID NO: 6896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccaaacacggttgtccccgaacccctgg

SEQ ID NO: 6897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccatcctgcgggccgtaggtctgagtcc

SEQ ID NO: 6898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccatgtttaccttgtccagcctcttgct

SEQ ID NO: 6899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccccactagccccctgtccgcgtgctgac

SEQ ID NO: 6900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccccgagtaagtcgcgcttgcatatcgga

SEQ ID NO: 6901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccgacgatggtgaccagtggggtacatg

SEQ ID NO: 6902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccgaggcgcacatttatgactccccttg

SEQ ID NO: 6903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccgcccagctgctccctcgtggaggtcc

SEQ ID NO: 6904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccgctcggactggttatagcagatactt

SEQ ID NO: 6905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccggggccctcgttttgcacgaggttct

SEQ ID NO: 6906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacccggttcctccgtatgggcgaagttacg

SEQ ID NO: 6907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccctgccttcttcactaagtcgtcacacc

SEQ ID NO: 6908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgacatcggacgttaccgccaatctccc

SEQ ID NO: 6909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgactaggtgcgagcggtaggcggcagg

SEQ ID NO: 6910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgatcatgcgtatccaaaagtgctgggt

SEQ ID NO: 6911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgatctaaaattagttattggacgcgtt

SEQ ID NO: 6912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgatctacctggcctgcgccggccgtga

SEQ ID NO: 6913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgccgatgtgtcgaaggtggagggtgga

SEQ ID NO: 6914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgcgtgggacggatttcgtatgtcgggt

SEQ ID NO: 6915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccggagtgcgtgggggaagcttcgatttc

SEQ ID NO: 6916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccggtactgttgactagacgctaatcatg

SEQ ID NO: 6917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgtatcgcgggcagaggtctttgaacgg

SEQ ID NO: 6918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccgtccactgttgtttactcttgattgtc

SEQ ID NO: 6919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacctcaggcatggcacatacttgcttgcta

SEQ ID NO: 6920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacctcattaacagcatgtacgtgccggggc

SEQ ID NO: 6921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacctctatatatctataggtatagcgtgga

SEQ ID NO: 6922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaccttggtgtcccaattggagctgcggact

SEQ ID NO: 6923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacctttgctctggccgtactcgatattaca

SEQ ID NO: 6924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgaacacgtgcggggactgggcgtcgccg

SEQ ID NO: 6925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgaacagttcgtctgcatcctacagcttg

SEQ ID NO: 6926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgacctgggggacgaagtcatgcgcgcct

SEQ ID NO: 6927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgagccccaccccaagagctgatgtaatc

SEQ ID NO: 6928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgagctgaagcgcggggcggatgttggtt

SEQ ID NO: 6929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgagggtaagttaggagtgcaccgcttgc

SEQ ID NO: 6930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgatgcacttgtgctgttcttacgaggtc

SEQ ID NO: 6931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgatggcagccgttaaactgactccctcg

SEQ ID NO: 6932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgattgttcatacggatttctcgacgtcc

SEQ ID NO: 6933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcaagggtctaaagttctcgagcctcgt

SEQ ID NO: 6934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcacgctcttaggccataccggattgtc

SEQ ID NO: 6935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcagacccattctccctaggcttcctat

SEQ ID NO: 6936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcagcgggatgagaggtgtggcgcggga

SEQ ID NO: 6937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcaggaatgcgccaatgggtccccaatc

SEQ ID NO: 6938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcatcttaatgggtgttgtgctgttgca

SEQ ID NO: 6939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgccaggatcactcggtatgttaaaatct

SEQ ID NO: 6940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgccatacgtgaacagatgagtgtgatgc

SEQ ID NO: 6941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcgaatttgcggcaatttcgtggttcgg

SEQ ID NO: 6942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcgcgcctcacctgccgttgtttggtcc

SEQ ID NO: 6943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcgcggctaaggggttcaacaccggtag

SEQ ID NO: 6944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgcggtggtgttctgtcaggttatcacac

SEQ ID NO: 6945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgctacacgatcaggagggcaatgttgcc

SEQ ID NO: 6946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgctgccgatggggtctggctgccgagca

SEQ ID NO: 6947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgctgtcatcgagctctaggaatacgctg

SEQ ID NO: 6948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggaatgtcactttttagccttctcatcg

SEQ ID NO: 6949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggagcgccttgggccccctccgagcttc

SEQ ID NO: 6950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggcagagtaaccatattaagttagtaga

SEQ ID NO: 6951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggcatcgtgggatatctccccacacgtc

SEQ ID NO: 6952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggcctgtccgttcatgatatgcgttggg

SEQ ID NO: 6953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggcgagaacgggatttgtgtccggaatg

SEQ ID NO: 6954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggcgatgcattagtgagctcaattgtgt

SEQ ID NO: 6955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggcggatagaaggctttatcctgtgctg

SEQ ID NO: 6956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggcggtaactgtatacatagcagcaaga

SEQ ID NO: 6957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggctcgcagcagacggtattccgatcat

SEQ ID NO: 6958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgggccagagacgagcttttggtggcccc

SEQ ID NO: 6959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgggcctggggggaaattaggtcttcgca

SEQ ID NO: 6960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgggcggttcgaatcaaagaatcaggccg

SEQ ID NO: 6961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacggggccgcatgaatttgcttgagcgacg

SEQ ID NO: 6962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgggtggtatgattggatggcgcatccgg

SEQ ID NO: 6963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtaataggtcctccaatttgtgtttttg

SEQ ID NO: 6964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtcagctgactgtcgggcccgtgttcgc

SEQ ID NO: 6965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtcctctattcgtggcatgatcctagtg

SEQ ID NO: 6966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtcctgccgtcaaatgggcagattgcgg

SEQ ID NO: 6967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtctgtcaggagcttcagcgctagggac

SEQ ID NO: 6968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtgacccaggttgaccactttcgtagca

SEQ ID NO: 6969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtgattagctatgttaggatgaagcggc

SEQ ID NO: 6970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgtggcgcctgtacgcgcgcactattgcg

SEQ ID NO: 6971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgttagggtctcgttcttccagatgcttc

SEQ ID NO: 6972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgttcaattgatagtgggccgcggcggtt

SEQ ID NO: 6973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgttgctgggttactcgacgaatgtttgc

SEQ ID NO: 6974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacgttgtcaggacaggtgtgaggtggccgg

SEQ ID NO: 6975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactaaataatttctatggaataaaggtttt

SEQ ID NO: 6976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactaagttgacgctatgttatcttcgtatt

SEQ ID NO: 6977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactactaatggatccgggcttcctccctag

SEQ ID NO: 6978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactataaggcttgtaccgtattgcaattta

SEQ ID NO: 6979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactcatatctggtgcgtttaagcgctggcc

SEQ ID NO: 6980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactcctcgggcatatgtaggtgtgtgaacc

SEQ ID NO: 6981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactcctgagagcagtagctgcctcctccat

SEQ ID NO: 6982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactcgaggccatgtgcgagggtttttcgtt

SEQ ID NO: 6983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactcgcccttccctccgctaataggcccct

SEQ ID NO: 6984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactcggtttacgtttctcattggtcatccg

SEQ ID NO: 6985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactcgtgctacctctgtgcctcgagacatt

SEQ ID NO: 6986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactctccccattcgctgcccggactggcct

SEQ ID NO: 6987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactctcttgagtccgcgtcgtttagatacg

SEQ ID NO: 6988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactgcatcgggggtttctcgcgggggcact

SEQ ID NO: 6989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactgccgcggaagcaaacgcactattcaca

SEQ ID NO: 6990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactgcggattcacttgcaactcaatttgtt

SEQ ID NO: 6991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactgctccccggaaccttcttttaatattg

SEQ ID NO: 6992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactggataacaggtgtaactacccatagac

SEQ ID NO: 6993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactggcgtattgttacctcgtcaccttcat

SEQ ID NO: 6994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactggtgcgatctggctcttgattgtcgcc

SEQ ID NO: 6995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactgtcacgctgccaatagcatgtcccaga

SEQ ID NO: 6996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactgtgggtaggaaaaacttcgcttggtct

SEQ ID NO: 6997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacttatatgatctcagttggtcgcctcctt

SEQ ID NO: 6998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacttccatagcctttcgattccgcgacgcc

SEQ ID NO: 6999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacttccatatgttctgtggagatacatctt

SEQ ID NO: 7000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agacttcgacgcacgcgatcaaatttttggtt

SEQ ID NO: 7001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agactttcatttacccacacctattctatgta

SEQ ID NO: 7002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaaagccaccgtatttgcgcattgggaag

SEQ ID NO: 7003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaaagcggattataggtggatcaagggct

SEQ ID NO: 7004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaacggtgtcagaagatttgggagaatgc

SEQ ID NO: 7005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaactagctgtatctgccaggcgagatct

SEQ ID NO: 7006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaacttccgtaagttccgggtgaagtgta

SEQ ID NO: 7007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaatcaagaatagttgccaggtgcatgca

SEQ ID NO: 7008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaatccgatcggtttcattatggccgtcc

SEQ ID NO: 7009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaatctcgcacataatctacactcggacg

SEQ ID NO: 7010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaatgtcctttcactcggcggcctaagct

SEQ ID NO: 7011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaattttcatgcaccgatatctcgacaat

SEQ ID NO: 7012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagacaattgcgaggtggagcagtgggaggg

SEQ ID NO: 7013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagacacaacgagtgcagctgaagtagtacg

SEQ ID NO: 7014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagacatcaagaacgggattatttgtgggcc

SEQ ID NO: 7015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagacccttgttcaagtcttccgggggcctt

SEQ ID NO: 7016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaccgtctccactaatccagtggcgctta

SEQ ID NO: 7017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaccgtgcgacgaatgaacaaggttacac

SEQ ID NO: 7018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagacggtgttggcaatcttgccgtgcagcg

SEQ ID NO: 7019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagacgttacgaccccactcttaaaaccagg

SEQ ID NO: 7020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagacttggggtcgacgaggattgatcagcg

SEQ ID NO: 7021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagagagttgctcagcagaagagtagctttc

SEQ ID NO: 7022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagagcagcaggcgcgaccgtgtcattcttc

SEQ ID NO: 7023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagagcctacacaagcgttctgatatttcgg

SEQ ID NO: 7024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagagcggcacacactgagggttaagtcctc

SEQ ID NO: 7025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaggacaagcgcgccgcatggtttgagac

SEQ ID NO: 7026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaggagtgtgttgacgggtacgtgaaggg

SEQ ID NO: 7027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaggataagatttgggcgcacaccccgtt

SEQ ID NO: 7028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaggcgtcttggggaaaacattgacattt

SEQ ID NO: 7029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagaggggtggacatcacggttagtatcccc

SEQ ID NO: 7030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagataccgatatgcacagccttgcgattgt

SEQ ID NO: 7031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatcgcatcggagcaatgggtgcaaggag

SEQ ID NO: 7032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatctgtgtgcagtggctccgttaatgac

SEQ ID NO: 7033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatgagcgttatattgtatgccccgcggt

SEQ ID NO: 7034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatgctttgaggtaagttactttaaacgg

SEQ ID NO: 7035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatggagagacgaatgggtctgaaggcga

SEQ ID NO: 7036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatgggaaactcaggcaccgggagtgcgt

SEQ ID NO: 7037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatgtcaggtgcttcactgccgttatggt

SEQ ID NO: 7038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatgtcggtttaagtcgctatggtacgtc

SEQ ID NO: 7039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagatgttgcaacatgaatgctcaaggggcg

SEQ ID NO: 7040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagattctattatggtccaatgtgtctgatg

SEQ ID NO: 7041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagattgcagcgcttttttctacacttccgt

SEQ ID NO: 7042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagattggctttacgatattttggcatcgtc

SEQ ID NO: 7043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcacggtagatcagtgttcccccgtttgc

SEQ ID NO: 7044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcactgggccccacacgagcagcgaccgc

SEQ ID NO: 7045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcactgtatctgtttgatcgcgcgtgtgg

SEQ ID NO: 7046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcacttcagagctgcggctagggatattg

SEQ ID NO: 7047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcagaggtgtgtttttcacaaagtggcgg

SEQ ID NO: 7048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcagctgtagagcgcgcgggttgctccac

SEQ ID NO: 7049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcagcttagcgtttttattctactatggc

SEQ ID NO: 7050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcataatggtgcgtggcatacgtcccgct

SEQ ID NO: 7051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcattacacgattcatcgaggggaacggg

SEQ ID NO: 7052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagccaattcgcctagcaacctatatagacc

SEQ ID NO: 7053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagccccaatctttgagagtggataccgtga

SEQ ID NO: 7054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagccgcattccgtccgtccttagtaaatac

SEQ ID NO: 7055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgagcctgtctcaaggtttgtgcgatcg

SEQ ID NO: 7056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgagcgtacggtctctctttagcgctcg

SEQ ID NO: 7057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgagctgcctctgaggccacacggcgtg

SEQ ID NO: 7058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgccgacaccttcaacgcgcgcgatgat

SEQ ID NO: 7059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgcctgtgttcatccgcgcaatcattgg

SEQ ID NO: 7060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgcgaagttgcacgatgcaagagggtaa

SEQ ID NO: 7061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgcggtgaccttttgattagcaggtttg

SEQ ID NO: 7062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgctgatttgctcgtgtgcacccgtttc

SEQ ID NO: 7063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcggaagcagttcgtgcaacaccagagcg

SEQ ID NO: 7064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcggacacatactcggcgttactctcaac

SEQ ID NO: 7065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgggaccttgcgcaatagttgtagggtg

SEQ ID NO: 7066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgggagaccgtgccgaattacccgtctc

SEQ ID NO: 7067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcggtactaagttagggatgtgcgagtcc

SEQ ID NO: 7068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcggtggagtgtttatgcattgaacggtt

SEQ ID NO: 7069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgtagcaggcatctcggcctcgtacttt

SEQ ID NO: 7070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgtcaaggattaaggggcctcgttctcc

SEQ ID NO: 7071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgtcagagcatgactcttgtgcgccctg

SEQ ID NO: 7072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgtcgtcaggtacgcaacaaagccccct

SEQ ID NO: 7073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgtctctaatctactgtttgactgcggc

SEQ ID NO: 7074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcgttactgcgcaccccggcctgtatctc

SEQ ID NO: 7075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctaggtggttatgactaaggttaccgcc

SEQ ID NO: 7076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctcaacatcgctggcatatgctactggc

SEQ ID NO: 7077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctcagtgattgtcagtgacacgctgcgg

SEQ ID NO: 7078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctcgatctttcagccaacgctccgtccc

SEQ ID NO: 7079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctctaggcagtattagtccgctcaatcc

SEQ ID NO: 7080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctgaacggggctgaactggccgcgagga

SEQ ID NO: 7081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctgccaagaattgaatatacactccgtg

SEQ ID NO: 7082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcttcttacggtatctgcggagggtctca

SEQ ID NO: 7083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagcttgtacactgaacggctagggaacatt

SEQ ID NO: 7084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagctttccgaaccatgcagaggtggaggcc

SEQ ID NO: 7085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggaaagcagtccgcacgactatgcaattg

SEQ ID NO: 7086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggaacagtaagtacctggcagcaaaaatt

SEQ ID NO: 7087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggacagtgcgggttagtgctcattacgag

SEQ ID NO: 7088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggacgatgcgcgaagcaatcagaaactgg

SEQ ID NO: 7089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggactagcttacctctatacagattcaac

SEQ ID NO: 7090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggactcaagggtggctggggtactgcgcg

SEQ ID NO: 7091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggagattgtgcgcggacacgtgttggttg

SEQ ID NO: 7092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggagcacagttgctgaactcaattaggtg

SEQ ID NO: 7093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggagcggctttgatctcgcccgtgcacgc

SEQ ID NO: 7094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggaggaacattaaaatcgccgccatggtg

SEQ ID NO: 7095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggagtccgacgggccctcgaagctcgaga

SEQ ID NO: 7096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggatactcgacaacgccgtccctccctgc

SEQ ID NO: 7097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggatgtgcattagccgggtagcgcctttc

SEQ ID NO: 7098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggatttatgcaattggagggaggttcctg

SEQ ID NO: 7099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggcacggggtggcctagggcgccagaggt

SEQ ID NO: 7100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggcagatgagtgggttgccttagggaatt

SEQ ID NO: 7101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggccaacaaccgtggactacacctttatc

SEQ ID NO: 7102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggccgcgacaatgggtcggtattggatcg

SEQ ID NO: 7103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggccggacgtttcgggcccggatgagctg

SEQ ID NO: 7104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggccggcgctgctcattctcagtcatttc

SEQ ID NO: 7105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggccggggcgtggatagcttataggcatg

SEQ ID NO: 7106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggcctcacaatgtccgacgcaattacgga

SEQ ID NO: 7107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggcgtatatctccgcagctcgcccattat

SEQ ID NO: 7108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggcgttgacaactatcgtttcaatgcacc

SEQ ID NO: 7109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggctccgttcactggctaggaagtataag

SEQ ID NO: 7110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggctttcacttacattttcatcttatgca

SEQ ID NO: 7111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggagttgttgtgggcggagggttgtagg

SEQ ID NO: 7112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggatgggctagttatatccgatgattag

SEQ ID NO: 7113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggctcgacaatgctcgttacggcggcgg

SEQ ID NO: 7114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggcttggggccgatggctgggtgccggt

SEQ ID NO: 7115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggggaaggcggaacctgcaacgtagcgcc

SEQ ID NO: 7116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggggacaactccgcctgaacctgtactc

SEQ ID NO: 7117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggggggaagtcttgacgtccgtcgaaact

SEQ ID NO: 7118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggggtgtcggttaattgaataaagccgc

SEQ ID NO: 7119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggtagagcacacttaagaagaaacaact

SEQ ID NO: 7120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggtggtccattgtcccttttgtcgctta

SEQ ID NO: 7121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagggtttcacgccaagctacatacttcacg

SEQ ID NO: 7122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtacgatcttcttccgagaaaggtggtc

SEQ ID NO: 7123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtacttgcgtggctcggttctgccccgt

SEQ ID NO: 7124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtagcctcggtccgggagctatcgcgct

SEQ ID NO: 7125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtcatcgtgtatacgggcagcccctccc

SEQ ID NO: 7126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtcattgtatgtaagcttccaccaacgg

SEQ ID NO: 7127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtccagtttatttttcgcgcctaagtta

SEQ ID NO: 7128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtcgcatctgctcccgtcgtcctcttcc

SEQ ID NO: 7129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtctgtggtcgtaccttgtctcagtgag

SEQ ID NO: 7130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtgcccggcttagataaagtggactacc

SEQ ID NO: 7131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtggaatgagcttagatacaaccgcttg

SEQ ID NO: 7132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtggcgagaaacacgcaacccaagcgtt

SEQ ID NO: 7133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtggcggtcaaactaggtactaacgccg

SEQ ID NO: 7134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggttgcatcggagtaataggcttcttgga

SEQ ID NO: 7135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggttgccaaactgggttcgctctctactg

SEQ ID NO: 7136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agaggtttcctgctacccgcgacacttagcct

SEQ ID NO: 7137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtaagcgggcaaccattaatgtgattggg

SEQ ID NO: 7138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtacattgtcagtccaacatcatggtcta

SEQ ID NO: 7139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtacgagttaatgtgtggttgtaacaccg

SEQ ID NO: 7140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtacgggaaacttgtcgccttccgttgcg

SEQ ID NO: 7141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtacgtatttgctaggaacggatgaaagc

SEQ ID NO: 7142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtagaagtgtagggttgtgcacgatggcg

SEQ ID NO: 7143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtagatagtcaaggagggaccagaatact

SEQ ID NO: 7144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtagcgactcaacctgcggtgtaggcccg

SEQ ID NO: 7145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtaggacagaatacgaagcggcctagttt

SEQ ID NO: 7146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtaggccggtggtagtgtgtgtatgttga

SEQ ID NO: 7147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtataaatgaggtacttgctttacatagt

SEQ ID NO: 7148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtatcggaagcacacatgtcgatagcccg

SEQ ID NO: 7149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtatgggggtttgcagcgttcttgtaatg

SEQ ID NO: 7150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtccccttctgcataattcggtccctgtc

SEQ ID NO: 7151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtcccgttgtactagaaagctaggggcga

SEQ ID NO: 7152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtctaactgcctggagatcgcatatgcgg

SEQ ID NO: 7153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtctgttaaagtttgtaggtttggagttc

SEQ ID NO: 7154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgaacgacgagcttttcgtgtgccttga

SEQ ID NO: 7155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgatcgccccataggcctaccgcgggct

SEQ ID NO: 7156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgcaccaaactatgtgcaatgagtagca

SEQ ID NO: 7157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgcacctgtgagcacggccggatgctgc

SEQ ID NO: 7158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgccgagtaatcaagggcttatccccga

SEQ ID NO: 7159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgcggtatttgcaaatcgggtattgtta

SEQ ID NO: 7160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtggggacagaggtgactctgtttctgag

SEQ ID NO: 7161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtggtatcaggcgggtccgggattgggtg

SEQ ID NO: 7162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgtatgcctgtcgcgcctcgttcaatcg

SEQ ID NO: 7163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtgtcaatgcatttaagtatgggcggagc

SEQ ID NO: 7164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttacgggtacgatttcggtagccaatag

SEQ ID NO: 7165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttacggtagcatgtccgtttagccattc

SEQ ID NO: 7166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttaggtcttcgaatgtcgtttacgtctg

SEQ ID NO: 7167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttaggttgtcggggctgtcggacgcatt

SEQ ID NO: 7168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttattcggatggagcaggtccaatccgg

SEQ ID NO: 7169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttcacaatcaatgagccgaactgaagtg

SEQ ID NO: 7170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttgccaaattgttacgggtcttgatgaa

SEQ ID NO: 7171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagttgtcgatacttcgccaagggaacaggg

SEQ ID NO: 7172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtttaaggggatgttgatgaagagaccgg

SEQ ID NO: 7173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agagtttttttgtgactggccgtcacacaagc

SEQ ID NO: 7174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agataagatggttttcgcgctagtcagcggcg

SEQ ID NO: 7175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agataagcattgacacgcccggtatacgcttc

SEQ ID NO: 7176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agataaggcatgctattcgtcacatgcgcggc

SEQ ID NO: 7177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agataagtaatcttgtagaaagaaggaatcgc

SEQ ID NO: 7178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatacaagaccaatacagcggaacctctaat

SEQ ID NO: 7179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agataccgggttggtcagcgttactgtattca

SEQ ID NO: 7180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agataccgttacgattcgtttcctcggcatct

SEQ ID NO: 7181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatacgaagcatcttgcaatctgtacttagc

SEQ ID NO: 7182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatacgagttctgacgtgccgctgttgagca

SEQ ID NO: 7183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatacgcacacgaacccgtcacccgcgcccc

SEQ ID NO: 7184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatacgcccagtaggcacatggcacagcctg

SEQ ID NO: 7185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatacgtttatgagttccgtacgtaagtttg

SEQ ID NO: 7186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatagaccgcttcacgttcggtttgctgttc

SEQ ID NO: 7187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatagatttgcgtttagcagcccttggtagc

SEQ ID NO: 7188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agataggtccgtcttcgttattgttaagggtc

SEQ ID NO: 7189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatagtgtttgcgcacaaacgtaggcggttg

SEQ ID NO: 7190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatagttctgagcggattcggcgtcgctagc

SEQ ID NO: 7191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatatacggagtttcaccacataggatgaga

SEQ ID NO: 7192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatatcagttcttattaaagtgtatgaatag

SEQ ID NO: 7193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatatgatgctaatagttgagccctgtagag

SEQ ID NO: 7194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatatgcaacaaggttacgtttttcctgttc

SEQ ID NO: 7195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatattgaaagatgccgcttcgggccccaca

SEQ ID NO: 7196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcaaaccgcaccaggtgtcgcgcgctcta

SEQ ID NO: 7197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcaagaaatgttggatctcaactcaatgg

SEQ ID NO: 7198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcactatactactcgcggggagctgatcc

SEQ ID NO: 7199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcagacgttctgtcatacttttgttgcgt

SEQ ID NO: 7200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcagctagccgcgaattaggtcctaccta

SEQ ID NO: 7201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcagtgcaatctaaccgcggactgcaaag

SEQ ID NO: 7202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcatacctcggggaattagacgatacgat

SEQ ID NO: 7203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcatcggcccggaattaggcttgcaggca

SEQ ID NO: 7204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcatgtgaggcacgctgtcggaacctgaa

SEQ ID NO: 7205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatccacatattggtatagccgcatcacgct

SEQ ID NO: 7206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatccacatgctcaatcatagtgcggatcgt

SEQ ID NO: 7207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatccccgctgcagacatcatgtggcaatgt

SEQ ID NO: 7208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatccgatttaccagtatcgcagtcttcacg

SEQ ID NO: 7209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcctgatagttgatctcgatcatggagtg

SEQ ID NO: 7210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcctgccactatccattgacctgcgctcc

SEQ ID NO: 7211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcgcaaggtcctccaaaatcacctggcac

SEQ ID NO: 7212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcgcacgaaattggtcactgtttgttctg

SEQ ID NO: 7213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcgctatggtcgctcgggaaatgtaattt

SEQ ID NO: 7214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcggcaagctcggtttttgcaatttaggg

SEQ ID NO: 7215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcggccattagtgtgcttcgattatgcga

SEQ ID NO: 7216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcgggacgatctggtgtccctcggctctg

SEQ ID NO: 7217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcgtaggcgttagtgttcggttttagttt

SEQ ID NO: 7218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctaactaggtgtcgtatgtatttgccat

SEQ ID NO: 7219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctaactgcatggctaaaaaatcggccaa

SEQ ID NO: 7220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctatggtagcctgtggtgtgacacgtat

SEQ ID NO: 7221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctattttagtcggtccaggcaatccttg

SEQ ID NO: 7222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctccagccgacggggggcaaagggtgca

SEQ ID NO: 7223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctctgtcggatcctggcgttcgattacg

SEQ ID NO: 7224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctgtgcttaatcatggtttatgggctct

SEQ ID NO: 7225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatctgtttccatgagtttgggcgtagcggt

SEQ ID NO: 7226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcttgctagaactgatctcgcatattgtt

SEQ ID NO: 7227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatcttgtgttctatggtgcgctttggacga

SEQ ID NO: 7228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgaaatgacagttaggtacttacctacgc

SEQ ID NO: 7229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgaatcggggactttgatacattaagtga

SEQ ID NO: 7230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgactcgaaactgcgctgcgtggccaggc

SEQ ID NO: 7231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgagccgaacgacgtgccaacggccgcct

SEQ ID NO: 7232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgataaacggccagatgtcatttatcgtc

SEQ ID NO: 7233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgatacatctcttcgtcctcgtgaccgtt

SEQ ID NO: 7234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgattagctggttttacgcacggcggtct

SEQ ID NO: 7235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgattcgatctgagactatcccttagttc

SEQ ID NO: 7236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcacaagagaattgtcgacaccacggcc

SEQ ID NO: 7237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcacgcgcgaaaatccgggcagaaattg

SEQ ID NO: 7238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgccgatgcatgttgctgtgtttctatgc

SEQ ID NO: 7239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgccgcgatgtccgggtagtgacaccttg

SEQ ID NO: 7240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcctaggcggtagggcggcgggccctat

SEQ ID NO: 7241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcgaatagtcgtttgactcgtatcaatg

SEQ ID NO: 7242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcgatatgaaacttgctctcacgtattc

SEQ ID NO: 7243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcgcgtgggtccagattcgggaggcggc

SEQ ID NO: 7244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcgggcgtaagtgtttgttgtaggattc

SEQ ID NO: 7245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcgggtgatgggtcgaagcgccgtgagg

SEQ ID NO: 7246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcggtagggggtgattaacgcttctgac

SEQ ID NO: 7247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgctaacacgaatgctgatagttagataa

SEQ ID NO: 7248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgctacgcgctgtcagaatgaaagcatca

SEQ ID NO: 7249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgctcggctaaatggctcatgcgcgagcg

SEQ ID NO: 7250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgctgttctaggagtcgaggttcgaggag

SEQ ID NO: 7251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgcttggttgcgtcttatcagggggctaa

SEQ ID NO: 7252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgctttggtgcgggtacatgaatagacac

SEQ ID NO: 7253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggaacaggcttggagtgcggatatgggt

SEQ ID NO: 7254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggaactaccgcgcatcctcttgcgtacg

SEQ ID NO: 7255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggaccctccctcgtcacatactcctgca

SEQ ID NO: 7256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggataggctcatcaatggactcgcgggg

SEQ ID NO: 7257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggccaagtagcgagctgccgcgtgtcgg

SEQ ID NO: 7258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggcgtctaattggggttggatagtgtta

SEQ ID NO: 7259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggctgtggggaagggcgatcctcgctcc

SEQ ID NO: 7260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggctttccgttgtcgggtcgaggtggta

SEQ ID NO: 7261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgggaatgcgacagttacttctaagtgta

SEQ ID NO: 7262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgggagcaggtgtcggtttagctccagcg

SEQ ID NO: 7263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggtaagtcccggtaattcaataggctcc

SEQ ID NO: 7264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggtacccgagtgacattcacgacgttcg

SEQ ID NO: 7265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggtcaggtgacggttactaagatcccgc

SEQ ID NO: 7266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatggtgccgtacttggctcatgttggatac

SEQ ID NO: 7267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtaataccgccccgatgggagcaggggg

SEQ ID NO: 7268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtagtttttgctgcttaaccggcatctt

SEQ ID NO: 7269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtctgtcggggatatatctgggggccat

SEQ ID NO: 7270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtgggcgccggtcattatggatgggctc

SEQ ID NO: 7271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtggggcctagcagcgtgcgatcatgag

SEQ ID NO: 7272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtgtagtctagccgggatgttccgatgt

SEQ ID NO: 7273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtgttcccacgcaaggcctggtgtactg

SEQ ID NO: 7274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgttagtatgctaccggagcgtcatcggg

SEQ ID NO: 7275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgttcatgtcttggattgttttttgtgaa

SEQ ID NO: 7276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgttgccgcgaattaggattctgaacgga

SEQ ID NO: 7277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgttgcgtcggtatcaccatgtgtgaacg

SEQ ID NO: 7278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatgtttgcgctttgacctttgtacctctgg

SEQ ID NO: 7279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattaatattgtctatgttgcagtaggactt

SEQ ID NO: 7280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattaatttagatttttgacacatcgcccgt

SEQ ID NO: 7281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattactgcatggaagggtgtacgctagtgg

SEQ ID NO: 7282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattagtatccttcacagaatccgttcttcc

SEQ ID NO: 7283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattcaattgagtatggcatgttgaatagat

SEQ ID NO: 7284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattcctgcttgcagcgattggcaacagggg

SEQ ID NO: 7285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattcggtaagtgtgctgtgaatgagttgtt

SEQ ID NO: 7286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattctagtgttcgctataatcctcggtatc

SEQ ID NO: 7287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattctgggaaggccggcggacgggccatgc

SEQ ID NO: 7288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattcttcccactatcttggccaggttctgc

SEQ ID NO: 7289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgacctcgagatctggtaccgcggcact

SEQ ID NO: 7290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgacgttctgtggtaagtttatggtgtc

SEQ ID NO: 7291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgaggaccacgaaatgatctgcgttatg

SEQ ID NO: 7292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgattgagctcgcttacgcattcctttc

SEQ ID NO: 7293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgcaacggaccttcatggcacggaacgc

SEQ ID NO: 7294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgcactgcttcaattttagtccgtattg

SEQ ID NO: 7295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgccggggcgcgcatcgtaatgtagagt

SEQ ID NO: 7296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgcggtcgcactcttagatgtcttttcg

SEQ ID NO: 7297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgctcggtttttgaattgactcgtctcc

SEQ ID NO: 7298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgctgcgatggcgtaagtgggggtaggt

SEQ ID NO: 7299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgggacaccgcagttagcgagctcatac

SEQ ID NO: 7300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattggtatgataatcgcgttaggtgatgct

SEQ ID NO: 7301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattggtccgattggcattgtgagatgggta

SEQ ID NO: 7302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgtgcatgcaccttgactccggttcgtt

SEQ ID NO: 7303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattgtgggtgttttcggtgtagggttgctc

SEQ ID NO: 7304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatttatcccgagctaaaccagcttgccgag

SEQ ID NO: 7305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatttcccttgggataatgattacgttgctt

SEQ ID NO: 7306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatttcgcttaatcggggttacgggcaatgt

SEQ ID NO: 7307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agatttgggttctgtcaggtggaaggtgccgt

SEQ ID NO: 7308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattttcactgagcgcgtgaacgtcgtggac

SEQ ID NO: 7309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agattttgccaattttgcattcatgtctgtag

SEQ ID NO: 7310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaaaaacgacgattcaatccttggtgcgc

SEQ ID NO: 7311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaaagatcagcgtgtcgctactgggggtc

SEQ ID NO: 7312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaactagggagtagttttggttagctgac

SEQ ID NO: 7313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaactcgtggcatagcggcttcctcaatc

SEQ ID NO: 7314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaactggccatagtacaggacgccgacgg

SEQ ID NO: 7315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaagagttacttatatgctaatcattttg

SEQ ID NO: 7316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaagctagacgccctgttctcctttgccc

SEQ ID NO: 7317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaaggcgcgtaggggttaggggacttggc

SEQ ID NO: 7318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaagggcaggcgagttccagtgacggaca

SEQ ID NO: 7319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaatgagaacagagagggggacggtgggg

SEQ ID NO: 7320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacaaattactttggttcatgacacgtga

SEQ ID NO: 7321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacaatcctcggcagatggcgcttaccgt

SEQ ID NO: 7322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacacggcgggtccgtaatgcaccggcgc

SEQ ID NO: 7323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacaggtgggctcatacattaggtcatct

SEQ ID NO: 7324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaccgagtccaagtactgggacatgtctc

SEQ ID NO: 7325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacgcgatatggcaataacatctgctggt

SEQ ID NO: 7326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacgcgggtgaatctgtccgcttggaccg

SEQ ID NO: 7327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacgcttggtctgcatatcgctgcatgtg

SEQ ID NO: 7328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacggttctgacgtctgatgggcccggca

SEQ ID NO: 7329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacgtaggtgatactatggcgagggcggg

SEQ ID NO: 7330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaacgtatgtgaacaattcccgtagtgcgt

SEQ ID NO: 7331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaactaggcgcgaacgaatcacaacattac

SEQ ID NO: 7332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaactcctcagttacatagccttctgcccg

SEQ ID NO: 7333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaactttaggagtatcgagcgtcccatggt

SEQ ID NO: 7334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagaaggcttcacatgcagggacttgact

SEQ ID NO: 7335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagagcggtagtccggtacgtgaacatct

SEQ ID NO: 7336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagcacggaaccaggtaagctggccattg

SEQ ID NO: 7337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagccctaaatgctccacgatacgtcatt

SEQ ID NO: 7338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagcgagtctgttgcttgtagcatcggta

SEQ ID NO: 7339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagcgatcagcatgttactgattcgcaac

SEQ ID NO: 7340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagcggcaagggcttactggcgtgggtac

SEQ ID NO: 7341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagcgggcttcattgaacggggttgtact

SEQ ID NO: 7342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagcggtggagtagttacgatcttcctgg

SEQ ID NO: 7343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaggctagtactcactttaggaagtatca

SEQ ID NO: 7344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaggtctgggggaatgctgttagggtcgt

SEQ ID NO: 7345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaaggtgtcgtgacaagtcgtaatctagac

SEQ ID NO: 7346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagtagattggcttaagaattttgccgat

SEQ ID NO: 7347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagtcgtccattttggtgtgagtctccat

SEQ ID NO: 7348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaagtgggttctgatttatcgacatgatct

SEQ ID NO: 7349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaataactcgctgttagtatcggccgttgt

SEQ ID NO: 7350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaataagccgcagccaacagttattagagc

SEQ ID NO: 7351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaatacccgctgaacaatggtttagaggtg

SEQ ID NO: 7352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaatgcacgatcatgagagaaccttggcca

SEQ ID NO: 7353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaatgggagctgctggagttatcgcacatg

SEQ ID NO: 7354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaatggggatgacacatcaccgcggtcaac

SEQ ID NO: 7355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaatgtcgcaggggccgttcgcgttcgttg

SEQ ID NO: 7356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaatgtggactctacgttgcgcaacaagcg

SEQ ID NO: 7357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaattcctcaatcacaaggttggggggtcc

SEQ ID NO: 7358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacaaacagtcgtgcttttcactaacgtaa

SEQ ID NO: 7359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacaaccatcagcctccttgggatgctcgt

SEQ ID NO: 7360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacaacggtctgttagtgatggtagaggca

SEQ ID NO: 7361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacaccatccagaccacgcgattatgattg

SEQ ID NO: 7362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacagacgcttacacactacggccgacgga

SEQ ID NO: 7363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacaggatgactcgggctttttctatgcct

SEQ ID NO: 7364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacagtccggacttggctacagggcgatac

SEQ ID NO: 7365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacagtcggcctgtcagtgcgtgtacgttg

SEQ ID NO: 7366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacagtcggtggcttcccacatcggtcttt

SEQ ID NO: 7367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacagtgatcgagaggggctaacaagcgtg

SEQ ID NO: 7368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacagtttcggattggctatggtgttgctt

SEQ ID NO: 7369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacatgcggccggagctagtgacgcgtggc

SEQ ID NO: 7370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacatgggttgcggatagtgcgcttggggt

SEQ ID NO: 7371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaccagatagcccctgcgcacgctgctgct

SEQ ID NO: 7372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaccagggttgaccacgggaggaattggca

SEQ ID NO: 7373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaccagtaactaagcccgggaaaagaaggg

SEQ ID NO: 7374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaccgcggacgtccaatcttgtgggggacc

SEQ ID NO: 7375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaccgcggtatgccgtcattgtgcgtgtgc

SEQ ID NO: 7376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaccgtgttcctgcccgtcgttcttagcta

SEQ ID NO: 7377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacctcgctacgtgatagctagacatcgaa

SEQ ID NO: 7378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacctgtaaaacgttgcagtctttgcccgt

SEQ ID NO: 7379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgaatgttaacaggttcggctgtatgtg

SEQ ID NO: 7380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgacaaggagccgccgttcgttgacgat

SEQ ID NO: 7381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgacgctaggtagtgtcacacgtttgta

SEQ ID NO: 7382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgactatgcagatcacggtatcggcttt

SEQ ID NO: 7383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgagggctagtgttgctgatgaagaagc

SEQ ID NO: 7384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgatcacgagcacattggtccttggctc

SEQ ID NO: 7385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgatcggtgttagtctcatgtgtatgtt

SEQ ID NO: 7386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgccggatgattaagatggttgtgactt

SEQ ID NO: 7387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgccgttagtacttccttctccctaaca

SEQ ID NO: 7388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgcggaggcgcatcgtatggggagcggg

SEQ ID NO: 7389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacggaggacccatggcgacaataccagga

SEQ ID NO: 7390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacggcgggtgagtagggtagctagaaagg

SEQ ID NO: 7391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgggagcaggcatctctatgttagaaag

SEQ ID NO: 7392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgggaggctgaccgcgggcccccgcgtc

SEQ ID NO: 7393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacggggtcgggcttgcggcgtcatggggg

SEQ ID NO: 7394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgtccagcgcctccgaggcggtgcagcg

SEQ ID NO: 7395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgtggtttctcctaagcgttcgcgcgcg

SEQ ID NO: 7396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacgtgttcaatccgtgagcagtcccggta

SEQ ID NO: 7397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactaagcgctttagagtatgttcgccgcc

SEQ ID NO: 7398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactaccctttagcggggatgaggcggagg

SEQ ID NO: 7399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactagcccacgtccatgatgctgtttttg

SEQ ID NO: 7400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactcagcaaacattactcttatatttgta

SEQ ID NO: 7401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactcatttggttcatattcatcacgtggt

SEQ ID NO: 7402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactcggtttagcgaagcacaagtgtttgc

SEQ ID NO: 7403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactcgttagtcgattcttacggtcggggc

SEQ ID NO: 7404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactgagaacgtttaccgatcgccggtcta

SEQ ID NO: 7405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactgtgaagggcaaggtcctcgtcgcgca

SEQ ID NO: 7406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactgtgctggtcacctcgatcccgggagt

SEQ ID NO: 7407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcactgtttagattgggatgtaagtcagagg

SEQ ID NO: 7408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacttacagttttgggcaaagcgatgcgtg

SEQ ID NO: 7409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcacttagaggattaatgtgtaccaatccgt

SEQ ID NO: 7410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagaatcacccgcaaaagacgaacgtgcaa

SEQ ID NO: 7411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagacacctcgcaataacccgtcactacgg

SEQ ID NO: 7412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagacagcgccggagcggatatcatggtcg

SEQ ID NO: 7413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagacagggaaggggccacaggttagtccg

SEQ ID NO: 7414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagagcgaatgggctcacctcacggcgacc

SEQ ID NO: 7415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagagggtcctggatgtactggcgggcgtt

SEQ ID NO: 7416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagaggtatgcccatgtcttccggtcctgg

SEQ ID NO: 7417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagatagttttgacgaaagtgtactaacgt

SEQ ID NO: 7418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagatcaataggaccggtacggagaagtgg

SEQ ID NO: 7419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagattggcacaggacagcacggtgcccgg

SEQ ID NO: 7420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcaagcctgtgcagcctgcggaagcctg

SEQ ID NO: 7421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcacggatacgagggggcgttggattag

SEQ ID NO: 7422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcagaggaacctaatgcagcaaggcagt

SEQ ID NO: 7423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcagcgatgttaacggatctggacaccg

SEQ ID NO: 7424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcccctttggcaattcacctttgactgc

SEQ ID NO: 7425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcctcgaagaattaacggaccctggatg

SEQ ID NO: 7426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcgaaggcaatgactggacttgcggagt

SEQ ID NO: 7427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagcgggtatcctggaacgtaatcgcgtcc

SEQ ID NO: 7428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagctatgttgcggtaatttagtaaatgtc

SEQ ID NO: 7429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagctcggtattcgttttgtcattgcaacg

SEQ ID NO: 7430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagctctcgaggacgagatagtctctacgg

SEQ ID NO: 7431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagctctgccgtttaatacacccctggccg

SEQ ID NO: 7432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagctgggaaccgacggcagaggcgcatgc

SEQ ID NO: 7433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggacaggaaagaaagatgtatgtatgac

SEQ ID NO: 7434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggactgctactccggttcggtcttcgtc

SEQ ID NO: 7435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggccgataagagatgcttcaggaatggg

SEQ ID NO: 7436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggcctgatgaggaatctttcgagaggtg

SEQ ID NO: 7437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggcgcaggttaatggccactcgtcatac

SEQ ID NO: 7438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggcgccaagtggttgaaatttggcccgc

SEQ ID NO: 7439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggcgtaattgacgattatgggtcgtttt

SEQ ID NO: 7440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggcttatatgactaacaagcgagctggg

SEQ ID NO: 7441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagggcttttggcgtgcggagcggcgcgtg

SEQ ID NO: 7442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggggcgtaactgatagagtctcacgacg

SEQ ID NO: 7443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggggctagaagggtgatatgattcgcgg

SEQ ID NO: 7444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagggtgctgtttagggcgtgggcacaagc

SEQ ID NO: 7445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagggttttggaactcgaactagtctgttg

SEQ ID NO: 7446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggtgtaactgtttcgcagcacgagtccg

SEQ ID NO: 7447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggtgttcctgcaggctgtaaacataaga

SEQ ID NO: 7448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggtgtttcctttgcctgtcggtaccgcc

SEQ ID NO: 7449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggttaggtgatttaacgcaggcgcaaca

SEQ ID NO: 7450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcaggttttacttttaaggagctacaaccga

SEQ ID NO: 7451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtaacgggggaagcgggataacagagct

SEQ ID NO: 7452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtaataatccggccatacatatctgcgg

SEQ ID NO: 7453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtacatactgtctcgctgaaccggttta

SEQ ID NO: 7454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtagagacatccggagatttctccgcct

SEQ ID NO: 7455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtagggcacgtcgggatagtcacgggcg

SEQ ID NO: 7456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtagtattggccctgaccgaaaacgaac

SEQ ID NO: 7457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtagtgccagtcgctgcgattcgatggg

SEQ ID NO: 7458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtattagtgcgtagtgagattgtaaggt

SEQ ID NO: 7459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtcgctggacccgcccgttcgccgtaga

SEQ ID NO: 7460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtcgggtctggattattattgagtttgt

SEQ ID NO: 7461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtgtgtttcccgggtttctgttgattat

SEQ ID NO: 7462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagtgttgaggtgcgacctatgatagacgg

SEQ ID NO: 7463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagttcagtatcacgcctagggaacggtct

SEQ ID NO: 7464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcagttgactcaaaaggcagttgcggccccg

SEQ ID NO: 7465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcataacccgttattatcggtaacacgcatt

SEQ ID NO: 7466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcataatggcccccgcgggaagtaccgtgat

SEQ ID NO: 7467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcataatttgttacgtgtgctggggtctgct

SEQ ID NO: 7468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatacgatctgcgtgttcagcccaagtgac

SEQ ID NO: 7469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatagagaagactcgtgctgccgggcaaat

SEQ ID NO: 7470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcataggaagagtctgctcgcggttcgccaa

SEQ ID NO: 7471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcataggttcacacgcttcctgtccttgcac

SEQ ID NO: 7472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatatgagaaggacaccaagtatggtaatg

SEQ ID NO: 7473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcaaaaggaaaatctggtaaagggcctg

SEQ ID NO: 7474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcaacgccttgggtgggtaccgtcaagt

SEQ ID NO: 7475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcaagctttacaacccaggatcacgcgg

SEQ ID NO: 7476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcactatgtctgtcgcagaggagggtgc

SEQ ID NO: 7477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcagtggtacatattaaagcataaaaat

SEQ ID NO: 7478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcagttgctaacatttcaggctctcgtg

SEQ ID NO: 7479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcagtttccgccgtactgtttctccgtc

SEQ ID NO: 7480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcatctataggttgatctacgcaaagag

SEQ ID NO: 7481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcgcggatttggtcgggtccgttcccgt

SEQ ID NO: 7482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcggcgtccaacggcgacaactctaggc

SEQ ID NO: 7483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatcgtggatatagcggcgtttgcgcaact

SEQ ID NO: 7484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgagttattttagttcctccattgatgc

SEQ ID NO: 7485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgcacgggaacgagtacgtccgtccttt

SEQ ID NO: 7486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgcacttaacaccggagttcgggaggtt

SEQ ID NO: 7487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgcatgtactcgccgtggggtttgatcc

SEQ ID NO: 7488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgcatgtgacttcgcgtagggggtacct

SEQ ID NO: 7489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgcccggggcggtacagttactgtgacc

SEQ ID NO: 7490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgcgaagctagggcagggtagacggagt

SEQ ID NO: 7491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgcggaaatgaggaactagcggggtgcg

SEQ ID NO: 7492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatggagcgtgcggtatgcgttaggaactg

SEQ ID NO: 7493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatggagtgagggtgtctgttcgtcgttcg

SEQ ID NO: 7494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatggcacgtgatcaggcagacgaaccgct

SEQ ID NO: 7495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatggggaccagttgcggatgctgtggttg

SEQ ID NO: 7496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgggggtgtctaagttgtgggccagagt

SEQ ID NO: 7497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgggtgaccgaggtgagtgggccctctg

SEQ ID NO: 7498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgtgacatgttcttgttagcctatgcgg

SEQ ID NO: 7499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgtggaatatcccaccgcacttaggttt

SEQ ID NO: 7500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgttgtattccggaccggcacatatgaa

SEQ ID NO: 7501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcatgttttccttccgatgttggttttgtgg

SEQ ID NO: 7502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcattacggcaccacgtcgtgtctagatcgt

SEQ ID NO: 7503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcattcgcgcgtaaatgtggaacgttcattt

SEQ ID NO: 7504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcattgcaattcacacggggggttgcaagga

SEQ ID NO: 7505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcattggcgagctcgccactaacggacttgg

SEQ ID NO: 7506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcattggctggagcgctgtgaggggatcgtg

SEQ ID NO: 7507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcattgtatagtggccacattgaagcgcttt

SEQ ID NO: 7508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcattttttcttgaggttacagccactgtgc

SEQ ID NO: 7509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaaaacgggcgtcgctaattatgtgcata

SEQ ID NO: 7510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaaaagcttgactgcccctccgcggagtt

SEQ ID NO: 7511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaaacatgggagaccttccgctgtagggc

SEQ ID NO: 7512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaaatggtgcgttaatctgtgtggtgctt

SEQ ID NO: 7513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaaattgatgagggccccgaacatcgtct

SEQ ID NO: 7514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaacctcggaaggaattgttacaagttcc

SEQ ID NO: 7515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaacggtagcgggccttgggagctaagca

SEQ ID NO: 7516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaacgtgcctggtaaacggagaccgcatt

SEQ ID NO: 7517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaagttcgacggatgtttttggaaagggc

SEQ ID NO: 7518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaatatgacgatgtgttctaaccttgttc

SEQ ID NO: 7519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccacaagtttctattgagcgggtttacgta

SEQ ID NO: 7520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccacactgcacaggtagtgatggagtggta

SEQ ID NO: 7521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccacagagcgcatgtgtgtgttggtactta

SEQ ID NO: 7522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaccagagtagatcctggcgtcatagcgg

SEQ ID NO: 7523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaccatccagttgataatgcggactgggt

SEQ ID NO: 7524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccacctcaactgacccgaggatgaggttac

SEQ ID NO: 7525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccacctgtgactgtacaatgggttttacgt

SEQ ID NO: 7526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccacgctatataatggaacttaaggtctag

SEQ ID NO: 7527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagaacgtatgtaaaaagtggacaaaggg

SEQ ID NO: 7528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagaggaactctagtatccccaccgcgcg

SEQ ID NO: 7529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagagtttgttcttgtgcgtcttaccggg

SEQ ID NO: 7530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagcacgtgcttcgtacggttgtcttgtc

SEQ ID NO: 7531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagcactatacccgcggcaggcaaagtgt

SEQ ID NO: 7532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagcaggcagttggggtagtactgcggat

SEQ ID NO: 7533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagcgcggttcgatttagatttgttacgc

SEQ ID NO: 7534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaggcagacgtttagtggggtggctgtat

SEQ ID NO: 7535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccaggcttacccgcggcggtccatcaaccg

SEQ ID NO: 7536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagggacacctctaaaccctctctcagtc

SEQ ID NO: 7537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagggtgacgcagctggtaattgccatca

SEQ ID NO: 7538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagtgagatcgaagcctgtttactgctgc

SEQ ID NO: 7539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagttaacgtttgggccgatgacgaaggg

SEQ ID NO: 7540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccagttccgccaaatgtggttagacactcg

SEQ ID NO: 7541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccataagatggtttaactccatatatgcac

SEQ ID NO: 7542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccatagggcagagagggacgtagtggatcg

SEQ ID NO: 7543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccatatgaaggaggaaatcattccgtacgc

SEQ ID NO: 7544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccatcggacagcgttccgcgtgtttcggtc

SEQ ID NO: 7545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccatcttagttgacaccgccgtagagctta

SEQ ID NO: 7546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccatgcactgcccccggtatgccgatgtgg

SEQ ID NO: 7547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccattgatcgctcacctgggagtaccgcat

SEQ ID NO: 7548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccaaaccttccactcgagctcatcggccg

SEQ ID NO: 7549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccaagctgagtgtatggcccgtcattcga

SEQ ID NO: 7550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccaataccgtaagtccccgatgccagttc

SEQ ID NO: 7551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccacatagggaaggtccggtggtggcggt

SEQ ID NO: 7552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccagatgcaagatccacaccccggctttg

SEQ ID NO: 7553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccatataggggactacaagatacatgacg

SEQ ID NO: 7554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccatcgtcgctgatttccccatggtaccg

SEQ ID NO: 7555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccattttcgttgaataggagcctgggcgt

SEQ ID NO: 7556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccaactccaccattagacaggccccgca

SEQ ID NO: 7557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccagttatcaacgcataggcagcaacca

SEQ ID NO: 7558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccgacgcaggtgagctcggtgagcaatg

SEQ ID NO: 7559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccgcggtatggactgcctcggattaatt

SEQ ID NO: 7560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccggcctcctcaagtatgtctctgatga

SEQ ID NO: 7561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccttatatgacgaggtacactagaccgt

SEQ ID NO: 7562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccttctttaatcccccttttagttgact

SEQ ID NO: 7563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccccttgagcggcctccggccctcaccttc

SEQ ID NO: 7564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgacggcttctctgttggccagtaagcc

SEQ ID NO: 7565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgaggccggtcttctcttgcacacatcg

SEQ ID NO: 7566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgcacctaggtactcgtaatccggtcgc

SEQ ID NO: 7567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgccggttaggaaactagcttagcacga

SEQ ID NO: 7568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgcggttttgaatggtcgcagcggtcac

SEQ ID NO: 7569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgctccacagaggtgtgcctatcgctcg

SEQ ID NO: 7570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgctgttgggagccggtggcccacgggg

SEQ ID NO: 7571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgcttgtggtgtttatatgctttctgtc

SEQ ID NO: 7572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccggcactgggagaaactgacaatgctgg

SEQ ID NO: 7573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccggcgacgcactgtacctgagtggggcg

SEQ ID NO: 7574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgggttaagacctgtctccagaagctac

SEQ ID NO: 7575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgtggaaggcatataggctttggattat

SEQ ID NO: 7576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgtggcagaagttgcaggggcagattag

SEQ ID NO: 7577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgtggtgcaagatcgtcgcagcatgact

SEQ ID NO: 7578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgttctccacccatttgcatagtacatg

SEQ ID NO: 7579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccgttgttcgcctgccccttgtcgaaagc

SEQ ID NO: 7580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctagcggcgatcatgataatgtgagggc

SEQ ID NO: 7581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctaggataacacataaaaggctttggga

SEQ ID NO: 7582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctatcaacgtgtcggttacatggcggtc

SEQ ID NO: 7583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctatgccattccgacaaaatagcttagc

SEQ ID NO: 7584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctattaagtgaggttcaaggcaaatcgg

SEQ ID NO: 7585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctcaattcccgagttttgcttgtatggg

SEQ ID NO: 7586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctcaatttgacctttaggtattgagaga

SEQ ID NO: 7587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctcatctttattacagtggaaaccctca

SEQ ID NO: 7588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctcctcgatgcgagcccggatacgtttg

SEQ ID NO: 7589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctcgaccgatggagatgagttttgaatc

SEQ ID NO: 7590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccctcgacggacgcattggcccaggttggt

SEQ ID NO: 7591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccttcatttaagttacccagcctaggtcc

SEQ ID NO: 7592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccttctcatgacctgccttgtaccacggt

SEQ ID NO: 7593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccttgacagtggaacatcgtggtagttag

SEQ ID NO: 7594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccttgtaggtaaacatagggcgaattatc

SEQ ID NO: 7595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcccttttgcacgaatgcgccctaaaacaat

SEQ ID NO: 7596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgaaagtctgatgaaggctgactttgtgg

SEQ ID NO: 7597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgaaggtacaggcaacggtcatgctcacg

SEQ ID NO: 7598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgacccgacaatgatcagacttgtccttg

SEQ ID NO: 7599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgacgccgtttgtcgcgtggggtgggatg

SEQ ID NO: 7600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgagtgacctcaggctaggcatcgagggc

SEQ ID NO: 7601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgatccccttataggttgacagcccgcat

SEQ ID NO: 7602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgatgtcccgaatcaggttgaaaattggg

SEQ ID NO: 7603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgatgtcgacgtagattcgccgcgtatgt

SEQ ID NO: 7604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgattttcgcctgccccgtggaggtattg

SEQ ID NO: 7605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcacccactttaggcgtcaatcagagaa

SEQ ID NO: 7606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcacgtagaggtaaccactgcaggcact

SEQ ID NO: 7607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcagtgcactaatgcacatgtgattggg

SEQ ID NO: 7608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcatcatgaagcaatttatcggtgcgga

SEQ ID NO: 7609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcccctaaagtgcccctcaacggcgtcg

SEQ ID NO: 7610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgccgcctcatgggcccttcctctcgacc

SEQ ID NO: 7611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcctctcgcatgaagtcatctgtgaggg

SEQ ID NO: 7612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcgaccgttagctttacttgttgcgggt

SEQ ID NO: 7613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcgactactttcgtgcccttcgttccga

SEQ ID NO: 7614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcgactcgcaagcttgcacttgattggc

SEQ ID NO: 7615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgcgcacgctagtatctctctctccactc

SEQ ID NO: 7616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgctaaggttaccccacatgccatcgtct

SEQ ID NO: 7617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgctgcacactccatggatcagtgagggt

SEQ ID NO: 7618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggaagacgagagctcgggtagcgcgaaa

SEQ ID NO: 7619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggaaggagcggatgcatttctgtgcagg

SEQ ID NO: 7620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggagggtgggttgagatcatcggcgtag

SEQ ID NO: 7621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggcatgggcttcggattcgtgggaaaat

SEQ ID NO: 7622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggccaagatttattctcacacctcgtag

SEQ ID NO: 7623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggccagcatactaaggctcacgcgcact

SEQ ID NO: 7624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggcctccctctgcaccacaaacaatctc

SEQ ID NO: 7625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggcgcacctgtctaatctatcggcatgg

SEQ ID NO: 7626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggcgtgtgttgggggtcatagtgtgtgc

SEQ ID NO: 7627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggctggaatgggcctacggcacttacgt

SEQ ID NO: 7628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggctgtaaaaaatcgggtggagatatca

SEQ ID NO: 7629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgggatatatttatagagttcttcgctct

SEQ ID NO: 7630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgggctgcttgtgtttctatgagtgtctt

SEQ ID NO: 7631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggggacaacgtgaggggcaagcatcaga

SEQ ID NO: 7632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggggcggatagcacgcttttatcagagc

SEQ ID NO: 7633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgggtagcggtagcggcctctgggagtgt

SEQ ID NO: 7634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgggtatcaggcaatacgaccgcaatgat

SEQ ID NO: 7635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgggtccgactcggcgatagggccggtgg

SEQ ID NO: 7636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggtacaatagaccgaatgcactccggag

SEQ ID NO: 7637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggtaggtactaaaatatccatccttgtt

SEQ ID NO: 7638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccggtggggtttgctgcgattcataggccg

SEQ ID NO: 7639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtaaggtcggacgatctacattttgtcg

SEQ ID NO: 7640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtagggaacgcaatcacgaggggcggtg

SEQ ID NO: 7641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtatgggcgctagactttttgcggcacg

SEQ ID NO: 7642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtccgacgacccccgttgctgcaggggc

SEQ ID NO: 7643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtcctaaattgacgtccttattccgact

SEQ ID NO: 7644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtcgcgcgtttacttcttgggttcggtt

SEQ ID NO: 7645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtgcaccttggcgccagtctgtgttccg

SEQ ID NO: 7646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtggcgcggaatggattaagtctgacgg

SEQ ID NO: 7647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccgtttactgttgtagggctatggcagact

SEQ ID NO: 7648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctaacggagatataagggccgtcatcatt

SEQ ID NO: 7649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctatcactttttcgtccagaactctggct

SEQ ID NO: 7650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcacacagagttctgtcccaaccttcgg

SEQ ID NO: 7651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcaccctagtgcgcgggcttgttcatgt

SEQ ID NO: 7652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcatattgggtgttatgcgaaggacgac

SEQ ID NO: 7653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctccatctgttataaatgctaggtggaga

SEQ ID NO: 7654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcccgcgaatggttccgggcacaaactt

SEQ ID NO: 7655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctccggaatcgttcttcatgtcgcggtcc

SEQ ID NO: 7656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcgcttggaaggtgacaccgcaggggtt

SEQ ID NO: 7657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcggtacgcgtccgaacgtggatatacg

SEQ ID NO: 7658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcggttactgtcagactggtactgcagg

SEQ ID NO: 7659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctcgtgttactttggatgaaggatactcc

SEQ ID NO: 7660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctctacgtgttacagtatagattgtcgcg

SEQ ID NO: 7661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgaacggtccctaagctgtttctagatt

SEQ ID NO: 7662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgatatttcgccccctcactgtgtattg

SEQ ID NO: 7663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgcatcctcggcgcccaacgctcgtgga

SEQ ID NO: 7664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgcctttaatagtggtatcacatccttt

SEQ ID NO: 7665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgctgagtcctgtgcttctcgtggattc

SEQ ID NO: 7666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgggctgcgcggtatcattatcctgcat

SEQ ID NO: 7667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgggtacgaacatacgtgaggtttatac

SEQ ID NO: 7668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgtataggtgatcctccgacctctaacg

SEQ ID NO: 7669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgtcgaacatgtgtgcccagcttcgtcg

SEQ ID NO: 7670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctgtcttgccatggacacttttggaatgt

SEQ ID NO: 7671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttaatccgtcgggccatggaacatcttc

SEQ ID NO: 7672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttagagagtaggtcatggttttggggcc

SEQ ID NO: 7673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttagcgccgcttgtttacctccttgtcc

SEQ ID NO: 7674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttccagtttcatagtcgggtgatcatac

SEQ ID NO: 7675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttcccgggtcttgatcggcgtcctgcgc

SEQ ID NO: 7676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttgagggtcttttatttatgtggctttg

SEQ ID NO: 7677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttgggtctagctggcgttaaagtgcgga

SEQ ID NO: 7678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttgtaccgaggtggtctggtacacgaac

SEQ ID NO: 7679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agccttgtttgttgtgcaaggttttttgctgg

SEQ ID NO: 7680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctttcactggttccgctgctttccggcac

SEQ ID NO: 7681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcctttttggcctcgtcttattggttcgcac

SEQ ID NO: 7682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaaagtccgccctgataggcatcggctc

SEQ ID NO: 7683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaacgtggccgaacgatctgaacatatg

SEQ ID NO: 7684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaaggcaaggggggagtaagcgaacggg

SEQ ID NO: 7685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaacacccgggagggaaactgtattgtta

SEQ ID NO: 7686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaccgacaggctctctatttgccaaggg

SEQ ID NO: 7687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaccgcgaatgcagaggcatctatcggc

SEQ ID NO: 7688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaactatgtaataaacaatcgtaaataag

SEQ ID NO: 7689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaagctgatactctttgaaatataccggg

SEQ ID NO: 7690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaggcatgcgcaggaatcacgttacgtc

SEQ ID NO: 7691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaggcgacgatgtcatcccagcggttcc

SEQ ID NO: 7692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaaggcgggcggttcgacttagcccaggt

SEQ ID NO: 7693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaagtgccatcattgcgaagattaaatct

SEQ ID NO: 7694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaatagggatattcatgccacctcgatgt

SEQ ID NO: 7695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaatatcctttgtccccctggttcacctt

SEQ ID NO: 7696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaatcggttgggatcggctgtacccaggc

SEQ ID NO: 7697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaatttccgcgaccgtcgttccggattct

SEQ ID NO: 7698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacaagctgtttctcctgttctgattggc

SEQ ID NO: 7699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacagccttacgtgcgttcaatcacggtc

SEQ ID NO: 7700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacagtcaagaccacgaacgatcgggggg

SEQ ID NO: 7701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacatctccaccacgcgcacatcggtcgt

SEQ ID NO: 7702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacattcacactctgctgtcccccgtccg

SEQ ID NO: 7703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaccgcgaggtacaggtatgtccgtgatg

SEQ ID NO: 7704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaccgtgagttcagcccgctacactgttg

SEQ ID NO: 7705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacctacgctggtaatgagaggccgaact

SEQ ID NO: 7706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacctcatattccgggtgctggtagatgc

SEQ ID NO: 7707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacgaggttaacacgactaaaggagttga

SEQ ID NO: 7708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacgcctgcatgtcgaataacaggacgaa

SEQ ID NO: 7709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacgctgtttcaacagccaggttttgccg

SEQ ID NO: 7710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacgcttgcaggatgggacttacagatcc

SEQ ID NO: 7711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacggagacaagttaacagtaagtttagg

SEQ ID NO: 7712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgactatttgcctgactttggttctgttta

SEQ ID NO: 7713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgactcgtcatgtcggaccgcgtcaacgcc

SEQ ID NO: 7714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgactggaggatctcgccgcgatttcctgg

SEQ ID NO: 7715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgacttcaaccggggcgttggagccagggc

SEQ ID NO: 7716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagaatgcttaactgggggtagaccttcg

SEQ ID NO: 7717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagactttattcgtttccaccttttctcg

SEQ ID NO: 7718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagaggaagcccgtgaaattcgtacccac

SEQ ID NO: 7719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagaggtgtaactctgttatggttcatgg

SEQ ID NO: 7720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagcaccgatagccgtagttcatttgctc

SEQ ID NO: 7721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagcagagacgtgtctaaaatccgcaacc

SEQ ID NO: 7722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagcgcgctgagtggtaaataggtgcgtg

SEQ ID NO: 7723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagcggaagacagctctgatggccgcgta

SEQ ID NO: 7724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagcggccttaaatgcttcgaacatgtta

SEQ ID NO: 7725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggacgaaacaggatcgccggaggggac

SEQ ID NO: 7726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggcaagcgaacgaatcgcagcatacgg

SEQ ID NO: 7727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggcgtgtggtctaatttagtatgttag

SEQ ID NO: 7728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagggaaacagctcccgcgtcgtacgtcc

SEQ ID NO: 7729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggggcagaaatcggcgcccttcgtatt

SEQ ID NO: 7730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggggcggtatggtgggacctcaagggc

SEQ ID NO: 7731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggtaggtacgcatgcacattccagggg

SEQ ID NO: 7732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggtatcaacagtttacagcggcactcc

SEQ ID NO: 7733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgaggtccgattgctactctcttattccgc

SEQ ID NO: 7734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagtgaacgagcgggatctccttcgcggt

SEQ ID NO: 7735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagtgacgctgacatcacttaggattcct

SEQ ID NO: 7736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagtgtatcgcgactgatttaagagccct

SEQ ID NO: 7737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagtttatacacttaccgcgacgactagc

SEQ ID NO: 7738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagttttgggcgtgattttttgcaaacgt

SEQ ID NO: 7739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgagtttttgtgttaatctcgaacaattgc

SEQ ID NO: 7740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgataaagcgtgctggacttcgtgctacga

SEQ ID NO: 7741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgataagccgtgcgacttccgtcctcgcga

SEQ ID NO: 7742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatactgcatgttcctccttttcctgcgg

SEQ ID NO: 7743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatacttcggcttaacgaacgatcggttt

SEQ ID NO: 7744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatagggcgacgaccgggctttgcggatt

SEQ ID NO: 7745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatatgccgttaagctaggacagcgctgc

SEQ ID NO: 7746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatcataacctgcatgtgggatcagcacc

SEQ ID NO: 7747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatcctagagcagaggtcagcggcggggc

SEQ ID NO: 7748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatctgtgctcgacgtgttattcatgcga

SEQ ID NO: 7749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatgagcgtattttcttcatttctccatc

SEQ ID NO: 7750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatgtccagtcatccgtcttacacgacac

SEQ ID NO: 7751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatgtgggccgacttacttcccgagttat

SEQ ID NO: 7752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatgtgtgacaaattcattgcatttatcg

SEQ ID NO: 7753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatgttgaggtcgtcaatgaggctatagg

SEQ ID NO: 7754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgattgcgtaatagagaattaacggttatg

SEQ ID NO: 7755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgattgggactacgatggttcgtccagagc

SEQ ID NO: 7756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgatttgtgaacgctactgcgaggatgtat

SEQ ID NO: 7757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaaatgacccccatgaagcaggcacaat

SEQ ID NO: 7758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaagatcatatataactgccttgggaca

SEQ ID NO: 7759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaatatttcacgtctgattctcagattg

SEQ ID NO: 7760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaatcaggtaattggctgcgtctgtctt

SEQ ID NO: 7761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcacaaggaatgggttcacaagcaaagtc

SEQ ID NO: 7762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcacacgggactccctacaccatgccctg

SEQ ID NO: 7763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaccaagaaggcatgggtgtccgagtcg

SEQ ID NO: 7764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaccacgttcccgtctaccgcggttatt

SEQ ID NO: 7765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcacggttagagccggcctccgaggttgg

SEQ ID NO: 7766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcactatgtactacgtctgtttccggggg

SEQ ID NO: 7767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcactgtctcgctgattcgtggtaatatg

SEQ ID NO: 7768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaggaaaaaggtcacacggatagtatgg

SEQ ID NO: 7769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcaggaagtgtacatttatcgtttgaacc

SEQ ID NO: 7770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcagggttataactgagacgtcgcagctc

SEQ ID NO: 7771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcagtaaaagccttgtgtcatgttaccgc

SEQ ID NO: 7772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcagtagcgaagaaaccggtaacatcaga

SEQ ID NO: 7773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcagtgcacaggagggcgggcggtcattg

SEQ ID NO: 7774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcatacatccgtccattctgacgtgaccc

SEQ ID NO: 7775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcatgggtctgtccgaacactgctggtag

SEQ ID NO: 7776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcattccatccgcaggtatcaggatcctg

SEQ ID NO: 7777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccaagcataatcttcaggcatctgttgg

SEQ ID NO: 7778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccacagcaaacacttaaaaccacgttgt

SEQ ID NO: 7779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccatcaagctagagcggtactgggtcgg

SEQ ID NO: 7780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccccagcgtttgcatgagtgtcacaagt

SEQ ID NO: 7781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccgaaagtaggctatgatttgagcgttc

SEQ ID NO: 7782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccgcaatcgaaatatatctcgctcggac

SEQ ID NO: 7783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccgcaggggatggagagacgttggggga

SEQ ID NO: 7784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccgccgagacacaagacactgcctgctt

SEQ ID NO: 7785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcctagacaatgatcacaaacgtgtggat

SEQ ID NO: 7786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcctccggtgacctggctccacggcctcg

SEQ ID NO: 7787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcctgctggggttcaacaacgttttcgtc

SEQ ID NO: 7788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgccttattgcacggccagaggaaaatatc

SEQ ID NO: 7789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgaaaatgggattgtgttatcggtgtgg

SEQ ID NO: 7790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgacccggaaatgcggccccgtaattgg

SEQ ID NO: 7791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgacctttggacatgttcgggctagact

SEQ ID NO: 7792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgactagccaattggccgggaccgcata

SEQ ID NO: 7793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgactggttccggtagacttactgctcc

SEQ ID NO: 7794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgagctgggcacacatacaaggtatagg

SEQ ID NO: 7795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgagtgccgtctgggtctatcgttgtcc

SEQ ID NO: 7796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgagttgaagtcttgacggtttagcgtg

SEQ ID NO: 7797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgcagtgggtccggctcgactacgtgtt

SEQ ID NO: 7798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgcatgcagccccttatcttaccatgtc

SEQ ID NO: 7799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgcccctaaaaggttctctgggagcgtt

SEQ ID NO: 7800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgccggggtaagatggtgaatgttcgcg

SEQ ID NO: 7801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgcgcgagatcatttcccaatagcgttg

SEQ ID NO: 7802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcggacgccacatcttccctcatcaaagg

SEQ ID NO: 7803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcggacgtgactctcagctccgggatgcc

SEQ ID NO: 7804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcggcgttgataggactggtcagctgttc

SEQ ID NO: 7805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgggaaaatgctgcctgacgtgttcggc

SEQ ID NO: 7806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgggctagcctggaaaaactcccacgca

SEQ ID NO: 7807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcggggcgtttgcgatggaggcgcacgct

SEQ ID NO: 7808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgggtcgacgtttgtatacaagtgggaa

SEQ ID NO: 7809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcggttactcgttaaagagctgttggaat

SEQ ID NO: 7810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgtaaatgctgcatccagaattgaggtg

SEQ ID NO: 7811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgtaaggttgcatttaggccctggcact

SEQ ID NO: 7812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgtatctgcgttgtcacatggaactccg

SEQ ID NO: 7813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgtcgacaaaatgacaacaatctacctt

SEQ ID NO: 7814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcgtggtcttgcctttcatcgcccagatc

SEQ ID NO: 7815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctacgatagcatcggcgggtggagattc

SEQ ID NO: 7816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctagcgtcccgctaatgtgctggtattg

SEQ ID NO: 7817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctatcatttagggccgacccgacgcgtc

SEQ ID NO: 7818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctattgaatttacttgtgaagacggccc

SEQ ID NO: 7819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctattggccgtaccattttaaggcgcta

SEQ ID NO: 7820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctcacgtactatgttgcccgcactggcc

SEQ ID NO: 7821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctcgaccttcgctttcgacgtgcctgtt

SEQ ID NO: 7822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctcggaatgctcttaaccgccccccgtt

SEQ ID NO: 7823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctctcggtagcatcatggcttagtagcc

SEQ ID NO: 7824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctgacggtgaaattctgattgcacgcat

SEQ ID NO: 7825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctgccaaggtgtttggtttgcggccctc

SEQ ID NO: 7826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgctgcgggatttacgttgggatggatttt

SEQ ID NO: 7827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgcttctcggaggggagcatgccgttgttt

SEQ ID NO: 7828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaaagcggtcctaggcaagggtggtgtt

SEQ ID NO: 7829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaacggttcaaaattgcacagctttcgg

SEQ ID NO: 7830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaatgccggggaccgactttccttgata

SEQ ID NO: 7831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaatgtggtgatctcaaccagtgtggtg

SEQ ID NO: 7832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaattccgctgcagagggcagcaaactg

SEQ ID NO: 7833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggacccggcctcaatggagcagtaatttg

SEQ ID NO: 7834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaccggaatttttgagagtttattactg

SEQ ID NO: 7835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaccggtccttatccttggttcaattgt

SEQ ID NO: 7836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggacctgaccacggctggctatcccgtaa

SEQ ID NO: 7837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggacgatgcgacctgaaccgctaccgtgg

SEQ ID NO: 7838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggacgtcggttttggtcctccgtgtcgcg

SEQ ID NO: 7839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggaggtttctagtgcgcgtagagatcggc

SEQ ID NO: 7840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggataggcaagaccgtctcttgtagcgcg

SEQ ID NO: 7841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggatgatgctcgggcgcggtctagttgtc

SEQ ID NO: 7842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggattgatggatttcgcatccgtttggtt

SEQ ID NO: 7843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcaaagttatcgtaacgccggggttggg

SEQ ID NO: 7844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcactcacaatcaggccttccgcgttcc

SEQ ID NO: 7845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcagtctgataggtgacaggccacgagg

SEQ ID NO: 7846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcatagatcccatagatggtcaatcgtg

SEQ ID NO: 7847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggccaagggacgttctgttggtaaatggg

SEQ ID NO: 7848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggccaccacttattctaaccgggcttcgg

SEQ ID NO: 7849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggccagctgggtccatatttcgggccgtg

SEQ ID NO: 7850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggccattgtcggacacaacctgcatgtgt

SEQ ID NO: 7851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcccgattgttcattacggctacgattg

SEQ ID NO: 7852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggccgacactcgcctactactcaggaata

SEQ ID NO: 7853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggccgtcggaggctgtgctggttttatac

SEQ ID NO: 7854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggccgttcaatttaactggtgcgtcacga

SEQ ID NO: 7855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcctatcacggcatcgtcacaacccgtg

SEQ ID NO: 7856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcctcgggaagtttgattcgtcgagtct

SEQ ID NO: 7857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcgcgggtatttcccggatttgcgtggc

SEQ ID NO: 7858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcgtacggaggtaaatccgaagacccgg

SEQ ID NO: 7859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggctcttctcactatacttccggaacctc

SEQ ID NO: 7860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggctggtggctaacaatgcccatcgttca

SEQ ID NO: 7861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggcttaatgtcgactcgggtcagctttta

SEQ ID NO: 7862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggctttatcttggtatcttagaacactcc

SEQ ID NO: 7863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggaaccaacctggcctatagttgcctag

SEQ ID NO: 7864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggaacgcgaaccggaacctcggtaaacg

SEQ ID NO: 7865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggaaggcctgttatggagggggtcgccg

SEQ ID NO: 7866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggagaattcgctctgcggaaccttagtg

SEQ ID NO: 7867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggcaaatccgttacagatgtgtttgtca

SEQ ID NO: 7868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggcagttgaacttatctctcgtcacttc

SEQ ID NO: 7869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggccaatacgttctgtccactttctggt

SEQ ID NO: 7870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggccggggagggggattgttactgcttt

SEQ ID NO: 7871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggccggggttctaaaactgctatcataa

SEQ ID NO: 7872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggctcaaccccttcgcctactgttttgc

SEQ ID NO: 7873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggctcatttcgatgcgccagtgttacac

SEQ ID NO: 7874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggctttccactaaccaggcctggactgc

SEQ ID NO: 7875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggggacgggtgttggaacctgcgcgaact

SEQ ID NO: 7876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggggattaggagagcggattatgggtcgg

SEQ ID NO: 7877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggggcatcggcgttggcgaaccgacggcg

SEQ ID NO: 7878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggggtggcggtggattgttgagattgggg

SEQ ID NO: 7879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggtatcatcacgtcgcgcttcggttacc

SEQ ID NO: 7880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggtgagcctccccacggcacttagtgtg

SEQ ID NO: 7881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggttagagccgtgacaacatcgtagact

SEQ ID NO: 7882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggttctggttgacatgccatgtgtgcgg

SEQ ID NO: 7883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggttgagaggtccactggcttatcattc

SEQ ID NO: 7884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgggtttaaccgggccacttttaggaggtc

SEQ ID NO: 7885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtaaggcttgatactatgcatcattttt

SEQ ID NO: 7886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtccgaagcgtcactccgccgtgctgcc

SEQ ID NO: 7887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtcgcgtgtatgtctaggattacactcg

SEQ ID NO: 7888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtgcacttccagatcagattattaaatg

SEQ ID NO: 7889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtggctagagcgaaggagggtaagcctc

SEQ ID NO: 7890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtgggaatatggttaatggcccccgatg

SEQ ID NO: 7891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtggttaatatgtgaagttgacccggag

SEQ ID NO: 7892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtgtggatgaaatgtgtcctagccccca

SEQ ID NO: 7893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtgtggcagctaggggagcgtcttttcc

SEQ ID NO: 7894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtgtgggatggattgggtgtcaatgttt

SEQ ID NO: 7895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggtgttagacgtgtgaccatataaactga

SEQ ID NO: 7896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggttcggttaggagatggacattcacgta

SEQ ID NO: 7897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggttggggattaagtagttcaataccgta

SEQ ID NO: 7898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcggttgtttatcggaacgtatacccatata

SEQ ID NO: 7899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtaaaccagcgacattatctgttggtatc

SEQ ID NO: 7900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtaattggtgaatctcgtttctgcccctg

SEQ ID NO: 7901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtacgggccgagatgatcctcgtacgtgt

SEQ ID NO: 7902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtactggcgggtactctacggtctttgct

SEQ ID NO: 7903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtagaatacgctgcggatctgttaacctg

SEQ ID NO: 7904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtagcgattcgatttaagctcccagagcg

SEQ ID NO: 7905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtataaccttggtaacccacagcgagtct

SEQ ID NO: 7906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtatcaaaggatttcctggaagggaggtc

SEQ ID NO: 7907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcaacacaagctccaataaccgaagctc

SEQ ID NO: 7908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcaccgttgagtcatacgtcagtggtcc

SEQ ID NO: 7909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcagacgggcagcatacgtaaggctaga

SEQ ID NO: 7910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcatcgacaaggatcagtcgcccaccgt

SEQ ID NO: 7911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtccagttcatccacgctcgtcgtcattc

SEQ ID NO: 7912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtccatggtcgcgtgatgctgctttgact

SEQ ID NO: 7913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcccctgtcgtccaatgggttatacatg

SEQ ID NO: 7914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcggcagcggatgcggcttgtctcggta

SEQ ID NO: 7915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcggttatagcgtggccgcaggaactgg

SEQ ID NO: 7916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcgtcacattgtgagctgggtagcgtag

SEQ ID NO: 7917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtctatgtatagtaacacttaaactttgc

SEQ ID NO: 7918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtctgcgaaattgtggcgtgtgtgcgtgg

SEQ ID NO: 7919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtcttgacgcctggcgggtgtcaattctt

SEQ ID NO: 7920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgacggttataagtttgaatttagtacg

SEQ ID NO: 7921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgagatcgatgtatggttcgtccgtgtt

SEQ ID NO: 7922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgaggctggataagcacggataggtttt

SEQ ID NO: 7923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgatgccggtctatcatccagcgaggct

SEQ ID NO: 7924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgcccttgaccctctcgtgggtgcactt

SEQ ID NO: 7925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtggatgcgctataggcctcttccctgct

SEQ ID NO: 7926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtggctgtgatcgccatgctaatactggg

SEQ ID NO: 7927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgggctgatcgggagacgacaccgttgg

SEQ ID NO: 7928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtggggacgtgccactggtgggtagctcg

SEQ ID NO: 7929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtggtgcgtcttaacgtacggggggcacg

SEQ ID NO: 7930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtggtttgcgctatttctaatagcggact

SEQ ID NO: 7931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgtccggtctacgttccatctaagtatg

SEQ ID NO: 7932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgtgacaccaaaactcgcatatcgcgac

SEQ ID NO: 7933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgtgaggagggaatcgcgggctctgttt

SEQ ID NO: 7934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgtgtaccttgtggaatacgtataaggt

SEQ ID NO: 7935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtgttaaagcttaatggacgggccatggg

SEQ ID NO: 7936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttaggagttgtagtatacctgtcgcttt

SEQ ID NO: 7937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttagggataagcgggacactagggttgg

SEQ ID NO: 7938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttataaatcgtcgtacccttaacagcgg

SEQ ID NO: 7939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttatacgacgatcggcaaggcacaaggc

SEQ ID NO: 7940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttatagggaaccggttgtatggcctgat

SEQ ID NO: 7941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttatcctcgcacgcttctctcgttacgg

SEQ ID NO: 7942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttcaaggtgtagagtgcttccccgctct

SEQ ID NO: 7943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttcccggcttgctgcatgtttattgcta

SEQ ID NO: 7944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttcgaccagaactcttgtcaaattcgtc

SEQ ID NO: 7945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttgaggcgcttgtgttggtgagtggccc

SEQ ID NO: 7946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttgggctaagttacgtatagggtccgcg

SEQ ID NO: 7947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgttgtgggtaagtcgggtgcccgggtctt

SEQ ID NO: 7948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtttagggcttactttacatctaccgtac

SEQ ID NO: 7949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtttatgcaccagaatgcatgctatggaa

SEQ ID NO: 7950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtttcgcaatcattccccgatgcgtttgg

SEQ ID NO: 7951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtttcggagcaaacactgttgcaggtatt

SEQ ID NO: 7952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcgtttgagaatcatcctgtggttcgcgtcg

SEQ ID NO: 7953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaaagtgggcgcagaactgctcgtatccg

SEQ ID NO: 7954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaagacgggcattatggtgtgttgcgcac

SEQ ID NO: 7955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaagagttcacgaggcagcatagacagtg

SEQ ID NO: 7956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaaggccctcgtgattcccagtagaatat

SEQ ID NO: 7957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaaggcgctaatcggtgtgtgtgttactt

SEQ ID NO: 7958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctacatgggactcccggtttgtgcgcgata

SEQ ID NO: 7959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaccaattacagctgaaatgccatcaccc

SEQ ID NO: 7960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctacccgactgcttctttgatatctttgcg

SEQ ID NO: 7961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaccggcccgggtccctcgtgaacgtaat

SEQ ID NO: 7962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaccggtttacatacaaggcttttcgtaa

SEQ ID NO: 7963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctacgtttcttcctgtggggaccggttctt

SEQ ID NO: 7964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctactcgtctgataggtaagccaatcggcc

SEQ ID NO: 7965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagaaaggcacaggagacgtctaccttcg

SEQ ID NO: 7966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagacatctaggcctttcattcgagtcgg

SEQ ID NO: 7967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagcaggaacaactctgcttccataggtg

SEQ ID NO: 7968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagcccggttgtctactacaacttattac

SEQ ID NO: 7969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagcgaacatgtagcgctttccaggttgg

SEQ ID NO: 7970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagctgcgacgtcagttcccctacactct

SEQ ID NO: 7971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaggaggggtcgactaggaagaacgtcga

SEQ ID NO: 7972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaggcggcctgcgaagtgcttaattataa

SEQ ID NO: 7973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaggcgggaccatttgctaccgacgtgtt

SEQ ID NO: 7974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaggcggtgtaacgtcacacgcatggttt

SEQ ID NO: 7975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagggaggatttaagtcgcacactggctc

SEQ ID NO: 7976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagggtagattagggatacgagagcgagt

SEQ ID NO: 7977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaggtgctttgattttattcgacggcgta

SEQ ID NO: 7978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaggtgggggatatcaacctaatacgcca

SEQ ID NO: 7979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctaggttcctgcattccgttagttgattct

SEQ ID NO: 7980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagtaagacacaactctagctcagtggaa

SEQ ID NO: 7981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctagtggagagcagcgtacatttaccatct

SEQ ID NO: 7982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctatatctcttttggcgaagaacagttttc

SEQ ID NO: 7983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctatccggacagagaaggttctttaggtaa

SEQ ID NO: 7984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctatccttgatcaccacgcgcggtcccacg

SEQ ID NO: 7985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctatcgaacaatgagccagcaggatctaga

SEQ ID NO: 7986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctatgacacaagcttacggttatcgcgagt

SEQ ID NO: 7987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcacctgttgccgctgttacctagctcgt

SEQ ID NO: 7988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcacttatcgatcgtccatggagtagtca

SEQ ID NO: 7989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcagacatcggagatggttccgcttaact

SEQ ID NO: 7990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcagtttgcacctcttgggtacgcgcacg

SEQ ID NO: 7991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcatagggcagcacctaaatacggcttac

SEQ ID NO: 7992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcatgcaatcgatgcgaatcgcgctgagc

SEQ ID NO: 7993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcattgcttacctgacaatccgttaaatc

SEQ ID NO: 7994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccaacaattttatcggtggcggggtcat

SEQ ID NO: 7995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccaaccgagttagctgcttgccactctc

SEQ ID NO: 7996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccaacggcacgtaatccttccaggtagt

SEQ ID NO: 7997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccagcatgagatcctgcctgtaactctt

SEQ ID NO: 7998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcccaactctgtaattgagaggtcgccac

SEQ ID NO: 7999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccggggtctctcacagcaatttctatgt

SEQ ID NO: 8000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccgggttcgtggtcttgtgcagtacttt

SEQ ID NO: 8001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccgtgttcaacgccatctgagaatactc

SEQ ID NO: 8002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccgttggggagttatgacggttggaggc

SEQ ID NO: 8003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcctcccgatgtgtcttcatacaatgggt

SEQ ID NO: 8004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcctctatcgcgtttatcacacgtcttgt

SEQ ID NO: 8005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctccttagtcgttgctctggcgtctgttta

SEQ ID NO: 8006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgaaacgtatctgcctcgatattttcgt

SEQ ID NO: 8007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgaccaggttgggtacatgccgtcctaa

SEQ ID NO: 8008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgagggcggtgcttccagtttaccgtct

SEQ ID NO: 8009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgaggttactaaccattcgccatgcccc

SEQ ID NO: 8010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgatcagttttgtaacatctccgtcggt

SEQ ID NO: 8011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgcacattcgacggcaatccatccatgc

SEQ ID NO: 8012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgcatggacctcgtgcaaccaggattgg

SEQ ID NO: 8013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgcctgggttgatctggattgccttagc

SEQ ID NO: 8014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgcgtccaccttttctgcagcgttatat

SEQ ID NO: 8015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcggttagacattagctaggctcgtttta

SEQ ID NO: 8016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcgttatgatagaaccatcaaccttacac

SEQ ID NO: 8017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctaaagatggaactgtctacgggagtgc

SEQ ID NO: 8018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctacttacgactatccctacgctccgac

SEQ ID NO: 8019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctagatggagcgttaatggggtggcgcc

SEQ ID NO: 8020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctagcggtggactcatggggggtgcgtg

SEQ ID NO: 8021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctagggaacttcgttcgcggtctagtta

SEQ ID NO: 8022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctgcagttaaggtggaagatgccggtgc

SEQ ID NO: 8023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctgttacgcaaaactaagtggcccacta

SEQ ID NO: 8024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcttccccggtatttttcacgcccgtcct

SEQ ID NO: 8025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcttggtatcccttcgctgtggattgacc

SEQ ID NO: 8026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctctttccacggcttgcgacctgaactatc

SEQ ID NO: 8027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctcttttcatgcctacctgtgggtataacg

SEQ ID NO: 8028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgaactggtctgccatccacatggactcg

SEQ ID NO: 8029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgaagttgcgctgttcctaataatctgct

SEQ ID NO: 8030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgaccgctgtggccaaacctgcaggtaac

SEQ ID NO: 8031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgacgtgctttataaagttcgtttgatac

SEQ ID NO: 8032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgactcgaccctaatgcccggtcgcaggc

SEQ ID NO: 8033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgacttgagcaagctttgcccgcgtagct

SEQ ID NO: 8034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgagcatataggacactccacgtatgctg

SEQ ID NO: 8035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgagttggaacaggtaagatagttgtggc

SEQ ID NO: 8036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgattccgcgaaaatccgagagtcagtta

SEQ ID NO: 8037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgattggttgttatctcttcctccgctgc

SEQ ID NO: 8038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcagtacgccccaaacgcctggagctgg

SEQ ID NO: 8039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcatccgaaaagacacatatagacgtgt

SEQ ID NO: 8040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcatgggggaaactcggagttgcgcaat

SEQ ID NO: 8041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgccaggatgttcagtattgaaccgtatc

SEQ ID NO: 8042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgccagggtcccgctgcagtcgaatccac

SEQ ID NO: 8043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcccggatatttcttcttgttgacatag

SEQ ID NO: 8044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgccgaacaggccatccgttaacttactg

SEQ ID NO: 8045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgccgtgacaaagaatggaagtaggttat

SEQ ID NO: 8046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcctcgcgcacgctgtaccgatgcaaaa

SEQ ID NO: 8047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcgaatcaatgagcactgggtcgctccg

SEQ ID NO: 8048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcgacctcgttctgggacagccctttgg

SEQ ID NO: 8049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcgagatcgaggccgacaaactcggggc

SEQ ID NO: 8050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcgaggctatgcgtgcgttcaggcggtg

SEQ ID NO: 8051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcgattcgctaatccgatttggctctag

SEQ ID NO: 8052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgcggttaatcgtaacgtaactgatgcgc

SEQ ID NO: 8053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgctcccgcattcataccggacggtctgt

SEQ ID NO: 8054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgctctcacgattccttcatcgaggcgcg

SEQ ID NO: 8055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgctggggtatcacacggtttcaaggtgg

SEQ ID NO: 8056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctggaaggtggtgtggcactgcgtagctca

SEQ ID NO: 8057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctggacaacccttcaatgtgcgtggcgacg

SEQ ID NO: 8058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctggacacgcatgctagcatataccagtcg

SEQ ID NO: 8059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctggatgccgccgtctgcatactcaccgag

SEQ ID NO: 8060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtaagcgcaaatttcaattgttatactc

SEQ ID NO: 8061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtacagctggcagcccaacttacgctat

SEQ ID NO: 8062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtacctgtgcaccctacatgattacgac

SEQ ID NO: 8063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtacgatcactgctcagcggtgtctgct

SEQ ID NO: 8064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtagaattaaacatctcaatcgatgtcc

SEQ ID NO: 8065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtagattgggtatacatgacgtcgtgat

SEQ ID NO: 8066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtcaacacgcgagtccggattcggtgac

SEQ ID NO: 8067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtcaacgcagcttgatatcaggggtggt

SEQ ID NO: 8068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtcacacttgtacgcctgtactggccgc

SEQ ID NO: 8069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtcatggtgtccattgtaatattaggcg

SEQ ID NO: 8070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtccctctgatgctcggtgtagtatctc

SEQ ID NO: 8071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtccggtggggtgactagcacctctgtt

SEQ ID NO: 8072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtcggcatcagcgattgtaaatggcagc

SEQ ID NO: 8073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtctacatgaatctgttcttgccatggg

SEQ ID NO: 8074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtggacatccgctgcggaattgatcggg

SEQ ID NO: 8075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtggagggcggggtcagcaggcgtacca

SEQ ID NO: 8076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtgtagacgatcaatctttatccctggg

SEQ ID NO: 8077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtgtatcgggagggagtccaccgtcctc

SEQ ID NO: 8078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtgtggcacggcgaatcaagcggcatgc

SEQ ID NO: 8079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctgtgtgggagtttcttcttcctccccgtt

SEQ ID NO: 8080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttaaatgcgtgctggcccaacggttgcgt

SEQ ID NO: 8081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttaagccgcatggtaggtctctgcctggg

SEQ ID NO: 8082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttacacggcccattctaacctcggctgcc

SEQ ID NO: 8083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttactgggcgacttctttgaatggcgcgt

SEQ ID NO: 8084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttagggcgcccaggcactggaatcgtttg

SEQ ID NO: 8085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcacacgaccggttacgacttttgatcc

SEQ ID NO: 8086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcacctcccgcttctctaaacaggttga

SEQ ID NO: 8087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttccagagagagccatgcaggatgttccg

SEQ ID NO: 8088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttccagcttgcatgggtgtctggtacaat

SEQ ID NO: 8089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttccattctggtcaccgtgtggactgcac

SEQ ID NO: 8090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttccggaccgcgatcgtccccgcccgctc

SEQ ID NO: 8091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcgatcgcccaggttgccgtttgttagg

SEQ ID NO: 8092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcggaacgactcgtaacagcgggttacg

SEQ ID NO: 8093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcggttgaatgttctggagaggcctgtc

SEQ ID NO: 8094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcggttgacgactgagatcgggcgtatg

SEQ ID NO: 8095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcgtgtcgtagggatagcttttgcctga

SEQ ID NO: 8096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttctgagtgcgtctggaggggaaattact

SEQ ID NO: 8097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttcttggtccctgcattttatatgatgga

SEQ ID NO: 8098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgacacgttattttgctaggctcggaga

SEQ ID NO: 8099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgagaacgattgacatccggtagtcata

SEQ ID NO: 8100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgagacataatcgaatggcaaggaagaa

SEQ ID NO: 8101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgatattctatgtaagtttgggagaggt

SEQ ID NO: 8102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgcaaaagcactgagctagagtagatta

SEQ ID NO: 8103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgcgcccagcggcatgctggaatgcaat

SEQ ID NO: 8104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgctcagctagcactggcgtatgggtct

SEQ ID NO: 8105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgctgatgtacacctcagtggcgttgta

SEQ ID NO: 8106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttggatcgaacaggggcgggaaatgtttg

SEQ ID NO: 8107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttggtacaccgttctcctagttcaaaccc

SEQ ID NO: 8108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttggtacgaggatatcgtaaacggtgtgt

SEQ ID NO: 8109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgtaaccggtacgagccgcggtccacgc

SEQ ID NO: 8110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgtccccaatgctgacatttaagtgcta

SEQ ID NO: 8111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttgtgggaggatcaatcccttgattatgg

SEQ ID NO: 8112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttaaagttataattaccgaacataatcc

SEQ ID NO: 8113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttacatgttctcgggttagtactaggtg

SEQ ID NO: 8114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttactcacgcggttctgggcctcctgcg

SEQ ID NO: 8115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttagcaggggtatcccatacggaccggc

SEQ ID NO: 8116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttatacatcacatacactcccacgcctt

SEQ ID NO: 8117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttatgtttgaggggtgtgcgtttcacgt

SEQ ID NO: 8118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttcactcacttatatcttgttcacgccc

SEQ ID NO: 8119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttctctgcagcgagtctacagtgatctg

SEQ ID NO: 8120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttgacccggtcatgatgttcaggtccgg

SEQ ID NO: 8121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttggcaagggatgtgtcgcctcgtttca

SEQ ID NO: 8122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agctttggctgacaagcgcagaaagtgcaggg

SEQ ID NO: 8123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agcttttgtgggaaagtggcaattagcgggat

SEQ ID NO: 8124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaaagtgtacgccggatgtagtcaagcga

SEQ ID NO: 8125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaacgatcgggtcgactgtcgtcactagc

SEQ ID NO: 8126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaactcgcgcggacacgattagtttctcg

SEQ ID NO: 8127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaagcattctgtcccctttctttgttggt

SEQ ID NO: 8128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaaggcgagtaccggggcatgtgggcggg

SEQ ID NO: 8129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaatctatagcaggtcagcctggacgtta

SEQ ID NO: 8130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaacagcaaaggcgtatttcgactgcaaag

SEQ ID NO: 8131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaccaagctttataagagtgctagtgcct

SEQ ID NO: 8132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaccatgtgcagggatttgcgtggatacc

SEQ ID NO: 8133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaacctacacaagaaatgctctcagagcat

SEQ ID NO: 8134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaacgggtctggttgtttgagagcaaccat

SEQ ID NO: 8135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaacggttatgacgagaaaacttctggtgc

SEQ ID NO: 8136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagcagtcttccgtctggctgggtacgtg

SEQ ID NO: 8137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagcagtgggaagacgctcttcaagtcct

SEQ ID NO: 8138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagccagacttcgttcaatgtgtaaccat

SEQ ID NO: 8139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaggatttaacttgtatttccgtctgcct

SEQ ID NO: 8140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaggcctccagtgcgtgtgctgataccgt

SEQ ID NO: 8141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagggcagtgggttttgctgtcgaccgta

SEQ ID NO: 8142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagggcgggatgatcgggcacatggtcat

SEQ ID NO: 8143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagggtatcgacaacaagttacttcgcga

SEQ ID NO: 8144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaggtggagtggggacctataagtttacg

SEQ ID NO: 8145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaggtggcttaggtttcttcgttcgtaca

SEQ ID NO: 8146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaaggttgccacgatccgagttggtatacc

SEQ ID NO: 8147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagtatatatcgggatgggtcatggtgag

SEQ ID NO: 8148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagtcacattaatccgtcaccttaggggc

SEQ ID NO: 8149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagtccgttgttaccttactccgcaatct

SEQ ID NO: 8150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagtgagctatcccaatcctcaccgatgt

SEQ ID NO: 8151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaagttcgatactgactctcagcacgtgat

SEQ ID NO: 8152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatacgaaatattgcttgtaatactcgtt

SEQ ID NO: 8153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatcacgttttacaccgaaccgggccgcg

SEQ ID NO: 8154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatcatgagttgcgccgcgattgtgcttt

SEQ ID NO: 8155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatcccggggagtgacaaggctcggatgt

SEQ ID NO: 8156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatgatgtaacctctctgtctagtctgcc

SEQ ID NO: 8157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatgccgagacagggcaccgtcaattctg

SEQ ID NO: 8158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatggaccaaagagcataaattcactgac

SEQ ID NO: 8159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatggtgccatcggctcacacctaccgct

SEQ ID NO: 8160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaatggtgctccgtccagtagatgcctcga

SEQ ID NO: 8161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaattgcggcaaccagcctttagtagtcgg

SEQ ID NO: 8162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacaaaaagatgggtagcatcacaaatgtt

SEQ ID NO: 8163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacaacaaggtgatcagacttttaccgtgg

SEQ ID NO: 8164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacaaccccggtcacccagtggtcacgtgg

SEQ ID NO: 8165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacaatgcttgccggcgtacatccccacgt

SEQ ID NO: 8166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacacacagagctaagtgtgccgggcggag

SEQ ID NO: 8167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacacacgctggaccattttgagaatcgag

SEQ ID NO: 8168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacaccgggccgcggccaaaactcagtggt

SEQ ID NO: 8169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacacgatcgtgcgggtcttgacatccggg

SEQ ID NO: 8170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacacggcgcgatcaggttcggtgcttggg

SEQ ID NO: 8171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacactgatagttccatgagcggaatttgt

SEQ ID NO: 8172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacagcgggaacctagtcacttcaggcaca

SEQ ID NO: 8173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacagtgtttggcgggactttgcgactatg

SEQ ID NO: 8174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacatacactggcagctggctacctgaagg

SEQ ID NO: 8175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacatcgagtgtagccaggagttgtttggc

SEQ ID NO: 8176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacatgtgcttcttccgcgatctctcctcg

SEQ ID NO: 8177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccaagcgcagctaggtacgcgccggtga

SEQ ID NO: 8178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccaataagaatcacgcgtttgcccaaac

SEQ ID NO: 8179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccagccatgcggagtggcgcaactttcc

SEQ ID NO: 8180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccatagtatcacaggaagggcctgctcg

SEQ ID NO: 8181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccattacggcgttgacggctacaagctt

SEQ ID NO: 8182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccccaagtgatgcatctcgcgatcagcg

SEQ ID NO: 8183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccccgacttatcttgttcgtttatgtgg

SEQ ID NO: 8184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacccggggacatccaatcgagccttgttt

SEQ ID NO: 8185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaccggcggtttgcggagcaccgacctaag

SEQ ID NO: 8186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacctaccgtagccataggacagttaatcg

SEQ ID NO: 8187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacctgggaagggactttagctatgcttca

SEQ ID NO: 8188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgagaaagtttaatgagcgcagaacgcc

SEQ ID NO: 8189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgagttatgtgctactgtcaaatgtatc

SEQ ID NO: 8190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgatgtgtccgtttcgttcccacatatg

SEQ ID NO: 8191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgccgcatgtcacgatctacggggactt

SEQ ID NO: 8192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgccgcccgacgggatacgatcgctctt

SEQ ID NO: 8193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgcggaggaccagcctcgaccgggcgat

SEQ ID NO: 8194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgcgggaaccgggacttgtcacacgtca

SEQ ID NO: 8195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgcgtgagccgtgcgccgattggattta

SEQ ID NO: 8196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgctggcactttgcgattacgcttcggt

SEQ ID NO: 8197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacggataaaagtacatctattctgcccac

SEQ ID NO: 8198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacggccatttgggaactgggtgcggttgc

SEQ ID NO: 8199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgggacgctacatgggtcacttcccgat

SEQ ID NO: 8200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacggggttttatggggttgcgccgtggta

SEQ ID NO: 8201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgtcgcatcattcattaggtgtattctc

SEQ ID NO: 8202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgtcggaaagtaagtctagggtggggcc

SEQ ID NO: 8203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgtgcgttgccattaactttagaggcgt

SEQ ID NO: 8204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacgttccattctgcaggagataagagcta

SEQ ID NO: 8205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactatctcaactcttacctaatcctcgtg

SEQ ID NO: 8206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactcagtacacgtcttacgcctcggctcc

SEQ ID NO: 8207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactccacgcggttcacttctcttcggcca

SEQ ID NO: 8208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactcgtcggacatacgggatgcctgaagc

SEQ ID NO: 8209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactgaattcagcgtgcgctgcaagtgcga

SEQ ID NO: 8210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactgactttcgtttcccgatcgccaatgg

SEQ ID NO: 8211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactgccggcgcccggtaatgtggatggcg

SEQ ID NO: 8212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactggattctaacctgaaggttccatgtg

SEQ ID NO: 8213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggactggcggacagatgctaaattgtctccg

SEQ ID NO: 8214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacttacccggagcatgatcgattggaagc

SEQ ID NO: 8215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggacttctcgctggtaatccgtaaatggaag

SEQ ID NO: 8216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagaaatgttaatgtatttaactcccttag

SEQ ID NO: 8217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagaagattaaggtgtccggatagctcatg

SEQ ID NO: 8218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagaagctacggagcggcatcgtgcaattc

SEQ ID NO: 8219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagaaggttggtgagcatgtaacgtattat

SEQ ID NO: 8220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagagcccctacgctgtttgcgagtccgca

SEQ ID NO: 8221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagagcgtttgtcgactgttgaagtattgc

SEQ ID NO: 8222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagagggacccagatgcaatgcttgccgga

SEQ ID NO: 8223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagatcgcctggggagggactcagcgggat

SEQ ID NO: 8224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagatggcattatggtatcttcatttccgg

SEQ ID NO: 8225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagatgttgtcgatacaatcctcagattct

SEQ ID NO: 8226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcaagcggtttcaaaaccttgttagaac

SEQ ID NO: 8227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcactcgccagataggattcagcgggtc

SEQ ID NO: 8228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcagggggagccctcatacgttgtgccg

SEQ ID NO: 8229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcataattactcgctagtagctcttgga

SEQ ID NO: 8230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcattcgacgagagggtcccactacctt

SEQ ID NO: 8231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagccgcttcggtttgctagtcagcccgta

SEQ ID NO: 8232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcgaaagcatagctcgagtagatcgggc

SEQ ID NO: 8233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcgatgttaccgcactaatctggcgagc

SEQ ID NO: 8234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcgcgggagtggcgatctattttgttgg

SEQ ID NO: 8235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcgtgtgaggccagttcgaggttctggg

SEQ ID NO: 8236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagctaggttagtttagtcggattcaggga

SEQ ID NO: 8237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcttgattgcttgtcaggtgtgggggtc

SEQ ID NO: 8238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagcttttaactaaggacccttttatcggt

SEQ ID NO: 8239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggaattaatcacggtcgtcggtcgtgga

SEQ ID NO: 8240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggacttcgttggttagtgatgcgtgtcg

SEQ ID NO: 8241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggagtttgcgacttcgaccctgactacc

SEQ ID NO: 8242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggcacactccctaaaggccgaatctctc

SEQ ID NO: 8243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggcacgtggcaggacttaggagggattt

SEQ ID NO: 8244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggccagtccccttactcccccttaccca

SEQ ID NO: 8245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggccggagaggtggaacctgcatgtctt

SEQ ID NO: 8246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggcgattgaccaacatggaacttggggg

SEQ ID NO: 8247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggcggacacttccggggttgccttcttg

SEQ ID NO: 8248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggcgtgccccagtgttctgtgatcgtag

SEQ ID NO: 8249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggctaatcgcgtttacccttttcttgaa

SEQ ID NO: 8250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagggcggacggcacattaatgcgttggga

SEQ ID NO: 8251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagggggcgctatattgtcgcaagaaagcg

SEQ ID NO: 8252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggggttctgctttatcccgatttccgcg

SEQ ID NO: 8253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagggtgataagtgcgttggtttcacgcgg

SEQ ID NO: 8254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggtacggtagtcatcgcggctccggggg

SEQ ID NO: 8255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggaggtcagccatgctcgctgaatcgggtgt

SEQ ID NO: 8256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtccaaccgcggggaataggtgtcagat

SEQ ID NO: 8257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtcggggattgcgccacagacataagtc

SEQ ID NO: 8258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtcggtctggccatgtggagaagtctag

SEQ ID NO: 8259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtcttgggtcatccacggaatgcattaa

SEQ ID NO: 8260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtgcactgccgagagggcgacggcatat

SEQ ID NO: 8261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtggcagcattcaacccgccgtggtgta

SEQ ID NO: 8262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtggtatccgggccagttccgtcacgat

SEQ ID NO: 8263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagtgtcacgtgatcgggatagaccgagct

SEQ ID NO: 8264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagttactcgtctcgagcttgaggaatttc

SEQ ID NO: 8265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggagttagccgagccccatcatgtttgggcg

SEQ ID NO: 8266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatacatgcgtaacggggccatttggcagt

SEQ ID NO: 8267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatactgcggggtgtcgcggccccgctcca

SEQ ID NO: 8268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatagcatcaggggctgtttccatcctcgc

SEQ ID NO: 8269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatagggttagaggttgatactcccttgct

SEQ ID NO: 8270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggataggtacacccgtggttcgcccagtcgc

SEQ ID NO: 8271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatagtcacagggtcaaacattcgaaccat

SEQ ID NO: 8272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatatagtgggcattgggataggcatcttg

SEQ ID NO: 8273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcaacacgagcaggatgcgccactcggg

SEQ ID NO: 8274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcaaggggagtcggataagaggctactg

SEQ ID NO: 8275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcaagggtgataaggtggttgctgcccc

SEQ ID NO: 8276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcacagcgaccttcgaacgcggagggga

SEQ ID NO: 8277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcagaatatctgcgacccgcgcattacg

SEQ ID NO: 8278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcagcggatgcgactaatcgcttgcagt

SEQ ID NO: 8279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcagggagacggacccagtttgcgactc

SEQ ID NO: 8280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatccgatgcgggatttgggtgggcagcca

SEQ ID NO: 8281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcctccatgccaacggtgggcaatctaa

SEQ ID NO: 8282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcggagtttaggtctcggaagggtcccg

SEQ ID NO: 8283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatcggctcccactgattgctgagtgctat

SEQ ID NO: 8284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatctgcagccgtagccggacggaacgttc

SEQ ID NO: 8285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatctgttacggacgcaggtgcaatcgggg

SEQ ID NO: 8286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgaagatatagggccgtggcgtttcgac

SEQ ID NO: 8287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgaatgccaatgcctgtggattgcttgt

SEQ ID NO: 8288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgcactgttgttcacctcagaccaatta

SEQ ID NO: 8289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgcgaagtgcccggggagcgaccttaaa

SEQ ID NO: 8290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgcgctccattcgatgtaatttcacatg

SEQ ID NO: 8291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgcgtctgggctaggatatctttcaggt

SEQ ID NO: 8292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatggcggaccggatccgacggtggtgtca

SEQ ID NO: 8293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgggggaagggttggtaccgagcccgcc

SEQ ID NO: 8294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgtccgcctagtaggtaatcagacaata

SEQ ID NO: 8295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgtgcaaaagtacgcgactcgtcggttt

SEQ ID NO: 8296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgtggcttcttttgatactggtggtgtc

SEQ ID NO: 8297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgttttgatcggagtctggctttgcaga

SEQ ID NO: 8298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggatgttttttctacgcgacaaacactggcg

SEQ ID NO: 8299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggattacttagggactaaccgcgctcacact

SEQ ID NO: 8300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggattaggttgatactgtgaacagtgtcact

SEQ ID NO: 8301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggattattgaggtgtgggacttctccagagt

SEQ ID NO: 8302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggattcatgcctgaccaaagcataagacctg

SEQ ID NO: 8303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggattctagtcccgtttgtacgccctctgcc

SEQ ID NO: 8304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggattgtcgtgatgttttgttgagtccgttg

SEQ ID NO: 8305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaaagatgcgtacttcgatgcgttcggcg

SEQ ID NO: 8306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaaatttcctcgtggctcctcgctaaagg

SEQ ID NO: 8307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaacccgcttactttatccttatgcgtcg

SEQ ID NO: 8308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaacctttggaacatcgcgtccttttgat

SEQ ID NO: 8309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaacgagcggaaccagacacggggacata

SEQ ID NO: 8310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaacgcgactcataggttcatctgtgcgg

SEQ ID NO: 8311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaactggggacctggccgctgatcgcgaa

SEQ ID NO: 8312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaagacttctgtttgcggcgtgtaatgcg

SEQ ID NO: 8313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaagccgttggggcgcacagtgggcaaca

SEQ ID NO: 8314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaaggacctggccagttggctcggacgac

SEQ ID NO: 8315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaaggagagctcgaaaaaagcaggactgg

SEQ ID NO: 8316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaagtcagccgccaattatcgcgcacgga

SEQ ID NO: 8317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaatacaggggccctgaagtttcaaccgc

SEQ ID NO: 8318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaatagcttccaatctgtaagcgcatcgt

SEQ ID NO: 8319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaatatctccctggtccctagctccacgc

SEQ ID NO: 8320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaatctacaacgagtgacagtagaccggt

SEQ ID NO: 8321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaatgcgacgacgcacgctttatcagtcg

SEQ ID NO: 8322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaatggattcccattcgatgatccgtctg

SEQ ID NO: 8323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacaacaacttacctatgctatatggtat

SEQ ID NO: 8324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacaaggttttggcacggtaccagaacgc

SEQ ID NO: 8325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacactccaagggcaagtgataatccttc

SEQ ID NO: 8326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacatgcggtgttctagcctctgttattc

SEQ ID NO: 8327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaccactcatattgcgcaatggccgctct

SEQ ID NO: 8328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacgaacgtggtggactttgtactcactg

SEQ ID NO: 8329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacgagatgagaaaatatcggtagacgtg

SEQ ID NO: 8330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacgagatggggtaaacccggagccctgg

SEQ ID NO: 8331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacgctacatcatacgagtatctaggtgc

SEQ ID NO: 8332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacgcttatcctggagggtcacggtgagg

SEQ ID NO: 8333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacggagaacggctctatcgagcgtagac

SEQ ID NO: 8334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacgggacgcataagctctaggggttgta

SEQ ID NO: 8335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacggtctatgagaggactactcgtgacg

SEQ ID NO: 8336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacggtgttctctgcctgcaatctcgcaa

SEQ ID NO: 8337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcacgtgttaatcgttcttatgctgataac

SEQ ID NO: 8338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcactagaaacttagagtgggcagtgcgag

SEQ ID NO: 8339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcactctgtttgtggtgattacggcacgtt

SEQ ID NO: 8340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcactggccgttgactgcaacgacacgcac

SEQ ID NO: 8341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcactgggagttagttgggcgctgatctgc

SEQ ID NO: 8342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagaactcgatcaacacccttgtacttta

SEQ ID NO: 8343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagaagtgggtttatgaagcggcaccctg

SEQ ID NO: 8344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagagaatgctaaggggcatggcgcgccg

SEQ ID NO: 8345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagagagtcacgatccgggcaggtacgcg

SEQ ID NO: 8346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagcccggttgttacggtagagccgctgt

SEQ ID NO: 8347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagcgcacagctaagtttttctgggtggc

SEQ ID NO: 8348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagcgcgcctctgaatcgccgatcaaggg

SEQ ID NO: 8349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagcgcgttaatgtgacccgttatcctcc

SEQ ID NO: 8350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagctacaccagctaggagggcccttcct

SEQ ID NO: 8351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaggatcggtcgccagagcaccttggccg

SEQ ID NO: 8352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaggccgggtccatgtgaacaggaagggt

SEQ ID NO: 8353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaggtggcaccaagcaggtgtacaggagg

SEQ ID NO: 8354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcaggttagtccagttcgtagctcggtacg

SEQ ID NO: 8355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagtagattttcagtcagcaatggatatc

SEQ ID NO: 8356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagtcgatgtcgatcccaggagaccttca

SEQ ID NO: 8357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcagttcccacgacaggcacttaagactcg

SEQ ID NO: 8358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatcccgtatagggcatgtctgctcttcg

SEQ ID NO: 8359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatcgacctctgcttacatatggctgcgc

SEQ ID NO: 8360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatctatggcggagaggagttagttgtgg

SEQ ID NO: 8361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatgagattgtatgcgagcccctccatac

SEQ ID NO: 8362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatgcgttaatcacagaagtactcaggtt

SEQ ID NO: 8363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatggctgacacgattagccttccatggg

SEQ ID NO: 8364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatgggttatatcaatagcctcggtgcta

SEQ ID NO: 8365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatggtacggactccaggatatcattctc

SEQ ID NO: 8366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcattacggggacttaggggtacattctgg

SEQ ID NO: 8367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcattgggttctgggtttcgtgcccgccta

SEQ ID NO: 8368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatttgtcgctagtggctagtgtctgttc

SEQ ID NO: 8369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcatttttcccaagcggaacgttggtgacc

SEQ ID NO: 8370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccaaacccaagtagggggagggggaagta

SEQ ID NO: 8371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccaacggcatagcttgatcaatcttgcgg

SEQ ID NO: 8372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccaagatccatcggttgtacacttaacgt

SEQ ID NO: 8373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccacccacccggtctcgaagtcaaagggg

SEQ ID NO: 8374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccacccagaattggtcaacttgtaaggcc

SEQ ID NO: 8375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccactcagtcttggggtttcccatgcgtg

SEQ ID NO: 8376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccagacgaagtagggagcctatggtaccc

SEQ ID NO: 8377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccaggttcatatgactgcttctacgtcta

SEQ ID NO: 8378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcccacgaatgtcttcctaactaggagtaa

SEQ ID NO: 8379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcccatggacagtggaagccgccctgtggg

SEQ ID NO: 8380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccccgctaagagcacgaccattgcggtcg

SEQ ID NO: 8381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccccggtaggaaacctggaccggacagag

SEQ ID NO: 8382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccccggtgataggaaggagtaacgtgcga

SEQ ID NO: 8383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccccgttagcccgtggtataacgtttaac

SEQ ID NO: 8384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcccgatcgggaaaacacgttgcatgggag

SEQ ID NO: 8385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcccgcttcctgattcggctgttggttaga

SEQ ID NO: 8386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcccgggcgggatgagtaacgcaaaatcta

SEQ ID NO: 8387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcccgttcggcggtcggacgagctgagccg

SEQ ID NO: 8388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcccgttgtacgcccgcgagcccgtatcat

SEQ ID NO: 8389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccctatggggtatacttggcatatcccgt

SEQ ID NO: 8390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccctcagttgtttttccagtcttgtgatt

SEQ ID NO: 8391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccctccggttcctatcagctacgtagggt

SEQ ID NO: 8392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgactgtataaggtacactttgctctta

SEQ ID NO: 8393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgagctcacacgtttggttcgagggctg

SEQ ID NO: 8394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgagctcactgttagcggtcttttgtct

SEQ ID NO: 8395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgattaggacatcaccctacttcgcaga

SEQ ID NO: 8396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgcactcgctccgggcagctgataccga

SEQ ID NO: 8397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgcagcgctaatttgaaacgcctctttg

SEQ ID NO: 8398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgccatctaggttttaagttgtttgggc

SEQ ID NO: 8399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgcgatatgttagtcttgttgacgtacg

SEQ ID NO: 8400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccggggagaacgagtagatcattgtgagt

SEQ ID NO: 8401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgggttgtatgagagtatcagttgtgct

SEQ ID NO: 8402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccggtaaggtgtacgctcacgtcggaggt

SEQ ID NO: 8403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccggtaatgaaaccgcggtcaatgaacca

SEQ ID NO: 8404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccggttcccaaggccagggaaatttttgc

SEQ ID NO: 8405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgtcccgaaggacaacggcatgccgtgc

SEQ ID NO: 8406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgtggaagcgagctgggcacacagtcgg

SEQ ID NO: 8407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccgttagtttggtcttgtgggctgtcttt

SEQ ID NO: 8408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctaggcgcacgttatgtttctattcccg

SEQ ID NO: 8409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctcgcacttagcgtgtccacatctttga

SEQ ID NO: 8410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctcgttcaattagcgctgacgttatcaa

SEQ ID NO: 8411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctcgttcgatagaatcgacaatggatgc

SEQ ID NO: 8412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctctatgtcctagcgattgcggttactg

SEQ ID NO: 8413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctgcaaatggtccgggtaaagtagatgc

SEQ ID NO: 8414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctgcaagggtcggtcccgcaataccgcg

SEQ ID NO: 8415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctggattggaattgcccttctagcggtt

SEQ ID NO: 8416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcctgttatagtccgcagtgcgacgagcgc

SEQ ID NO: 8417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccttaacgatcgactggcacctggtaggg

SEQ ID NO: 8418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccttacgcatgatcggcgcatctgctctc

SEQ ID NO: 8419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggccttgagcgcgcatccccaaagcagattg

SEQ ID NO: 8420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgaaccaaagtgagagagtgatcccgata

SEQ ID NO: 8421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgaaccaagacactgagggggctctggtc

SEQ ID NO: 8422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgaaccacaaccacggtggggtctttcaa

SEQ ID NO: 8423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgaagcggaggatatcatctcccccttcc

SEQ ID NO: 8424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgaaggcagcgcgacgcggctgatccgat

SEQ ID NO: 8425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgaatctgatgcttaccgaccggttggaa

SEQ ID NO: 8426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgacaacactgagtgtaatggcgaccgga

SEQ ID NO: 8427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgacgggccgaggcgacacaggcaggaag

SEQ ID NO: 8428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgagcgaggggcgatgaaggtgtcaatgc

SEQ ID NO: 8429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgagtcgaagaagcacggcgggagagttg

SEQ ID NO: 8430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgataaagtgctcagcaggtgatcgccgt

SEQ ID NO: 8431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgatgacgtagtgaactccgtatctagat

SEQ ID NO: 8432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgattagtcatccccagctgacctcggcg

SEQ ID NO: 8433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcaatggagaacgggcccacaactgccg

SEQ ID NO: 8434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcacatttgccctacctcagccgttgca

SEQ ID NO: 8435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcactagtaacccggcttgatctcatcg

SEQ ID NO: 8436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcagctatagcgtggcaaatgcttgatg

SEQ ID NO: 8437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcatatctctggcatttttccttaggca

SEQ ID NO: 8438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcatccgaagtctccacagcggcgatca

SEQ ID NO: 8439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcctacgtcatgggtatgtagtagctta

SEQ ID NO: 8440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcgacccgtggttcatcatggcggcgag

SEQ ID NO: 8441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcggagagattgcagctgaccatgcgtt

SEQ ID NO: 8442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcgggtagcgttaggttcagctcctatg

SEQ ID NO: 8443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcggtccttggtcctgactggccgcctg

SEQ ID NO: 8444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcggtcgtccccacgagtcgagtggtct

SEQ ID NO: 8445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcgtacttgtcggtaagctacaatgagg

SEQ ID NO: 8446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcgtgcattggtgtgggtgggttgtccc

SEQ ID NO: 8447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgctcaatggcatctcgggttacacccgt

SEQ ID NO: 8448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgctctctcatctcagaggtgccaggagt

SEQ ID NO: 8449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcttcttatctgacgtggattcactctc

SEQ ID NO: 8450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgcttttatggcgtggtccggaggcttgg

SEQ ID NO: 8451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggacgcacagaccgcaaggcttacgctc

SEQ ID NO: 8452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggacgtaagggctccgttggcgtatgca

SEQ ID NO: 8453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggaggcttctccgatgtccgcgatgtgg

SEQ ID NO: 8454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggagggttcctgggcgacggcaaccgta

SEQ ID NO: 8455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggatcgataggtgcaaggatcggcgtcc

SEQ ID NO: 8456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggattgcacatggcaggcagaaccgtcc

SEQ ID NO: 8457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggcaaccttctgttcagatcggcggtac

SEQ ID NO: 8458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggcaccttggtcctgactagtgttactg

SEQ ID NO: 8459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggcgcatgcaacagcaaccctcaacggt

SEQ ID NO: 8460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggcggctcggtagccagtcgctgcggct

SEQ ID NO: 8461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggcggtcttgggtaaggtacccctcgtt

SEQ ID NO: 8462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggcgtgtattggactcaggtaccgcact

SEQ ID NO: 8463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggctggttcgttatgttttttcatagtg

SEQ ID NO: 8464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgggagtaggtggcgtatctagcggaacg

SEQ ID NO: 8465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgggcaaacgccgtctattagcttactgc

SEQ ID NO: 8466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgggcatgcgagcagacgcatgaacgtcg

SEQ ID NO: 8467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgggccttcgcaagggaaactgggtgggt

SEQ ID NO: 8468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgggggtgctttaacttgacggattatga

SEQ ID NO: 8469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgggtggcagagttttgttgctttcgcgc

SEQ ID NO: 8470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgggtggggcttggcaagtcacatccgaa

SEQ ID NO: 8471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggtccgtcgcgcaggtggacaacacact

SEQ ID NO: 8472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggtgcaatcaaaaccgactgtacgtggt

SEQ ID NO: 8473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggtgccgaagggtggagaagtacggagg

SEQ ID NO: 8474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcggtgggaagacctcgaaaggagcggtga

SEQ ID NO: 8475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtaccgatgggcttatttaagttaaaat

SEQ ID NO: 8476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtaggagtcccgccagtatgctctgctc

SEQ ID NO: 8477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtaggccctacgttcgtacaagattctc

SEQ ID NO: 8478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtcggcgaatcgcagtagaggtttcagg

SEQ ID NO: 8479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtgacagagctgatctgatccgcaaatg

SEQ ID NO: 8480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtgcggatgtgttgcgctggctaggttt

SEQ ID NO: 8481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtggcatggtcatccagttcgcctggga

SEQ ID NO: 8482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtggctccttgcatgaaatttcggactg

SEQ ID NO: 8483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtggcttggatttcttagtttcactcaa

SEQ ID NO: 8484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtgtagcgagcccttttgtactaggtag

SEQ ID NO: 8485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtgtaggtctgcagtcgtcgatagtttc

SEQ ID NO: 8486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgtgtgtcaggaggcctgatcaagcagat

SEQ ID NO: 8487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgttagagagaatatgctggcgcggcagt

SEQ ID NO: 8488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcgttcactagcgggaggcggggttatcat

SEQ ID NO: 8489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctaaggcgggcccgacgtaacttgtgcct

SEQ ID NO: 8490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctacagagcttccttagacatgtggtgtc

SEQ ID NO: 8491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctaccatattgcgatggcaaaacggcggt

SEQ ID NO: 8492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctagctactggcagagctcgcgcattgtt

SEQ ID NO: 8493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctagcttccgaagggttggattgtaattg

SEQ ID NO: 8494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctagtgtgcgatcgtgacaaccggtacga

SEQ ID NO: 8495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctatcgagtatacgcggagaactcacggt

SEQ ID NO: 8496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctatcgtaactcgccgtgcgcacgctgat

SEQ ID NO: 8497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctatgccttagactcgcttcaggaggcac

SEQ ID NO: 8498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctatttcagccatttcgatttagttcagt

SEQ ID NO: 8499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctcacgggcatgtcgttctcgcacctgac

SEQ ID NO: 8500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctcagttcatctgattctatcaaggggac

SEQ ID NO: 8501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctcatacgcatgttggcataagggtatac

SEQ ID NO: 8502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctccaaaaggacatacaggagttcacatc

SEQ ID NO: 8503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctccaggcgcttgccgctgttcatgatta

SEQ ID NO: 8504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctcgactgggctctatgttgacttactta

SEQ ID NO: 8505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctcggcgatagggtcgatatttcggtcgc

SEQ ID NO: 8506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctctcgacgccttattggtgcagtgacgg

SEQ ID NO: 8507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctctcggtggtcgagtggatgcatcgtag

SEQ ID NO: 8508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctctgtgattggtaagaggcgcccacctt

SEQ ID NO: 8509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgagcgtcatgtatcggagggccttatc

SEQ ID NO: 8510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgcaacaatctcgctgggtatagtatct

SEQ ID NO: 8511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgcccttcgaatggtttcccgttaggtc

SEQ ID NO: 8512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgcgatgtattctctcgttatactgggg

SEQ ID NO: 8513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgctatccctttaatgtggtatcgctac

SEQ ID NO: 8514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgctgtttggactgaagtgggaggtaca

SEQ ID NO: 8515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctggacgatcgacttgcatctttggcggc

SEQ ID NO: 8516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctggccaatacgacagttctgcaagaggg

SEQ ID NO: 8517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctggcggcactttgaagtttccttttcga

SEQ ID NO: 8518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgggtgtgaggagtacgtgcgtccgtca

SEQ ID NO: 8519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgtcagacgttgccctaccctgaggctt

SEQ ID NO: 8520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgtccgatgcatattatgtgttagtcct

SEQ ID NO: 8521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgtgaacttgcggtctaggagggggagc

SEQ ID NO: 8522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgtggcaagaggaagtgaatcggttccg

SEQ ID NO: 8523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgtggggtttaaaactaaagcgtggggg

SEQ ID NO: 8524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctgtggtctaaagcagtctcttgacgtat

SEQ ID NO: 8525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcttagccattatttcccgggcaattgtag

SEQ ID NO: 8526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcttcatgatgccacggcggagtctcgatg

SEQ ID NO: 8527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcttgacacgccgccagacagctaacgaat

SEQ ID NO: 8528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcttgcagcacaatctggacattacgttca

SEQ ID NO: 8529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcttggtggcaatagcgcgtctcatcccta

SEQ ID NO: 8530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggcttgtgatagctggtggcaagtatttcgt

SEQ ID NO: 8531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctttcaccggcaccttgagcgggttatcg

SEQ ID NO: 8532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggctttgcgttcgcgtgactggttgagatga

SEQ ID NO: 8533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaaaacgtactcactctctgcttgttgtg

SEQ ID NO: 8534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaaaaggttcccattaaggtctgccgcat

SEQ ID NO: 8535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaaaatacgccaagcttgccgcgcagagt

SEQ ID NO: 8536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaaactttagcgtccccaaatttgggtaa

SEQ ID NO: 8537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaaagggtagccttcggtacttcttcggg

SEQ ID NO: 8538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaacacgatttcctatttacctggttcgg

SEQ ID NO: 8539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaacacgtttgggccaatttttcacttag

SEQ ID NO: 8540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaaccggttctcggttttgtttttcaatt

SEQ ID NO: 8541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaacgtcactctccaggtagtggctcagg

SEQ ID NO: 8542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaacgtccggagcacatattcgcggcacg

SEQ ID NO: 8543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaacttattcgtgcttaccacgttagttt

SEQ ID NO: 8544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaacttgttgcttgaagtctattgttgag

SEQ ID NO: 8545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaaggtgcgcacctgctaggagctagccg

SEQ ID NO: 8546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaagtttgacgtggggcggcgttccggca

SEQ ID NO: 8547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaatcggcgctgtggcgtatagtgacagg

SEQ ID NO: 8548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaatggtgtacgtggagagatctcctccg

SEQ ID NO: 8549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaatgtgcccttgtatcgggccgctgggg

SEQ ID NO: 8550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaattcagcacgtgatgagggacagagca

SEQ ID NO: 8551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggacaacggactcatggacacagtgtcatc

SEQ ID NO: 8552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggacagattatggggaaattgatcatctcg

SEQ ID NO: 8553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggacatagtacgtttactcgtctcactaga

SEQ ID NO: 8554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggacggttggagtaggactttatcgtctcg

SEQ ID NO: 8555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggactaaatccatcgtcagtctagttggtg

SEQ ID NO: 8556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggactatcttgggtattcgctgaggaaagg

SEQ ID NO: 8557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggactatgtcaatggcaaacttgtggagtt

SEQ ID NO: 8558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggactccgggggtaaaaaaatcatggccgt

SEQ ID NO: 8559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggactcttaacgctggcctgcagtggcggg

SEQ ID NO: 8560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagaacgccacacattccatacaactgcc

SEQ ID NO: 8561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagacaggcggctcagttcatagcacgcg

SEQ ID NO: 8562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagacagtcgggcatggtgccacggcgtg

SEQ ID NO: 8563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagccagcgttggccggtgggagtggggc

SEQ ID NO: 8564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagcctcgctactacttgtttccgcctcg

SEQ ID NO: 8565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagcgaggcggccggaattatcgcacgag

SEQ ID NO: 8566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagctcaactgggacgactacggtctccg

SEQ ID NO: 8567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagcttgcagtctaggaagccccgattac

SEQ ID NO: 8568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaggacgttgggagccagacggcaatacg

SEQ ID NO: 8569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaggcagttttactcccttacagcacgag

SEQ ID NO: 8570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaggccaggatatgattgagagctttcgg

SEQ ID NO: 8571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaggggactaggttcccaagagcgctgtg

SEQ ID NO: 8572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagggtctcgtaggctatttgttcactgt

SEQ ID NO: 8573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagggttctgtcgtcagatgtcgcgagtc

SEQ ID NO: 8574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaggtcgcacgtgcaataaatggagcgct

SEQ ID NO: 8575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggaggtggaacccgtacaagggcttgtagc

SEQ ID NO: 8576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagtagcaacatgttaccatacctagcaa

SEQ ID NO: 8577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagtaggcaaagggtctatttgcatggcg

SEQ ID NO: 8578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggagtgaggggacttgtgtgaccgcttggg

SEQ ID NO: 8579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatatattcagtcacgtactttgatttga

SEQ ID NO: 8580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatccaagcaacgctattgtaacaatgtg

SEQ ID NO: 8581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatgaatcagagtgtcgtacagcattttc

SEQ ID NO: 8582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatgacgtgcatagtgcacagcacggtta

SEQ ID NO: 8583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatgcccgaggaggttcactgctacgccc

SEQ ID NO: 8584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatgcgagccctacctgggtttttctctc

SEQ ID NO: 8585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatgtggaaaatgtatttatggattcaaa

SEQ ID NO: 8586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatgtggggacgtgcggtaatcctctgcc

SEQ ID NO: 8587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggatgttcgcttctgctcaatgcaacagcc

SEQ ID NO: 8588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggattacggaacaaggctaccgagaagctc

SEQ ID NO: 8589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggattttggcagcgcggttatgcggatact

SEQ ID NO: 8590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaacatgtggtacagggtggatcgatcc

SEQ ID NO: 8591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaactaaacccttcaagacgggcacagg

SEQ ID NO: 8592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaagcggggcaggttcacgtggggtatt

SEQ ID NO: 8593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaataaataggggcgcccgtgcggaagt

SEQ ID NO: 8594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaatactctatatattactatgactcgc

SEQ ID NO: 8595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaccgctggtcctgttagttccccgctt

SEQ ID NO: 8596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcacgggtggcgcaaccaggtagcaggtg

SEQ ID NO: 8597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcactaactcgcactcatccagtgttggt

SEQ ID NO: 8598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcactcctaatgttcggttagtatcacga

SEQ ID NO: 8599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcactcgaccgtcgacgacatcgccctta

SEQ ID NO: 8600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcactggacacccagatggatccacttaa

SEQ ID NO: 8601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcagcgctcgccgtacgttccggcctatg

SEQ ID NO: 8602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaggacgctgttaccaagcctgcatagc

SEQ ID NO: 8603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaggcgagaataatccgcgcggggccgg

SEQ ID NO: 8604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcaggtaccgagtaaagattcatttgcgc

SEQ ID NO: 8605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcagttacgctccttctgctataaccgtc

SEQ ID NO: 8606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcagttagagattttgcagcatggtacgc

SEQ ID NO: 8607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcatagaggcggttactctcgcttcgtag

SEQ ID NO: 8608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcataggacggaaattgcgatttgctgcg

SEQ ID NO: 8609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcatgctgtggtagagtgttttgtgttgg

SEQ ID NO: 8610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcatgtcagtaaactccaccgatcatacg

SEQ ID NO: 8611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcatgtgacgggtatgtcagttgggtgcg

SEQ ID NO: 8612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccatagatgaatctcaggtatcggtgcc

SEQ ID NO: 8613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcccttctctgttccgggcggtcgagtgg

SEQ ID NO: 8614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccgaccttcgctctgggggtctcttagc

SEQ ID NO: 8615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccgcgcgtcgtctaagagagccacagta

SEQ ID NO: 8616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccggacgtcgagacatgtattaactata

SEQ ID NO: 8617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccggtatacgtcgcgtgaacaacacaca

SEQ ID NO: 8618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccgtaacggtcatatgcccagaagtatt

SEQ ID NO: 8619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccgtctaccgagtaccgctgaggtcacc

SEQ ID NO: 8620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcctcggataaggcaggatgtaataaact

SEQ ID NO: 8621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcctgtacgagtccttttgctgtgtcagc

SEQ ID NO: 8622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccttcccacagcccgttgccttgtgatc

SEQ ID NO: 8623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggccttcgctgcgaaaggggtgtggtgcgg

SEQ ID NO: 8624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgaatcgtaaggcgcatcatcttctcga

SEQ ID NO: 8625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgacaccaatgccaattacaagcccggc

SEQ ID NO: 8626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgagggtctcggtctgatcagtggggac

SEQ ID NO: 8627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgagtactaacccacggtcacgatcgcc

SEQ ID NO: 8628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgcacatgcagcgactcagactctggtg

SEQ ID NO: 8629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgcatagtgcgtcgcaaagggcttattg

SEQ ID NO: 8630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgccgagactatgtcagtggaggtacgt

SEQ ID NO: 8631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgcgccacagattcctcgacagtgcttg

SEQ ID NO: 8632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgcgccttttcgatccgctaggcgcagt

SEQ ID NO: 8633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgcgggtaggtgacgggtactcattggg

SEQ ID NO: 8634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgctcctagtacttacttgtgtgacagc

SEQ ID NO: 8635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggacggcggacaagcttcgaatggggc

SEQ ID NO: 8636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggcaacatgttaaatcattatacttgc

SEQ ID NO: 8637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggcaatgctcacacagattgtatgggt

SEQ ID NO: 8638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggccacatgttgatcgggatctgggat

SEQ ID NO: 8639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggggctacggttgctatgtggtggcct

SEQ ID NO: 8640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgggggatctccctataggtccaggtcc

SEQ ID NO: 8641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggggggagcatatggctaactatcctg

SEQ ID NO: 8642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggtacgggagatcaagataaatgcggg

SEQ ID NO: 8643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggtcgatatcgatatcggtagtattga

SEQ ID NO: 8644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcggtgcgtcagactagaaactctcgttc

SEQ ID NO: 8645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgtatgtcataattggccccgtgtgact

SEQ ID NO: 8646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgtccactacggagcaagtcatcttcga

SEQ ID NO: 8647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgtcgagcaaaataaaccctcggcatgc

SEQ ID NO: 8648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgtctcattgtttgggtcgtacttcttc

SEQ ID NO: 8649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgtctttggggcgggacatatcgaggga

SEQ ID NO: 8650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcgtgtaccgattgagtcggtgagtccta

SEQ ID NO: 8651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctaaaacagttgtggtcactacgggaga

SEQ ID NO: 8652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctaagaagtgcctggtaattcggatgtc

SEQ ID NO: 8653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctaatccaagactagctgtagaactttt

SEQ ID NO: 8654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctatcttatcctgagcagaatgtcgccc

SEQ ID NO: 8655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctatcttgtctctattaacctttctaac

SEQ ID NO: 8656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctccttcgcttaatttattgacgcttaa

SEQ ID NO: 8657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctgagcacgctggtaccattgctattag

SEQ ID NO: 8658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctgcgggtgcaaaatgactggtgcaggg

SEQ ID NO: 8659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggctgggtctctcctctctgaaacaacttc

SEQ ID NO: 8660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcttagcaatctcgactcatgcggtgttc

SEQ ID NO: 8661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcttattttatggtcgggctttatgctca

SEQ ID NO: 8662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggcttgagcggcagggggtaagtgctggtg

SEQ ID NO: 8663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggaagatgcgtggatgactgtgggggcgg

SEQ ID NO: 8664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggaaggactcgactgcattatcagatgtc

SEQ ID NO: 8665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggactactgcttgcacccggggaacctaa

SEQ ID NO: 8666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggagatcacgagcactatgtggtcacccg

SEQ ID NO: 8667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggagccagtgcactatcgccgatgccatg

SEQ ID NO: 8668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggagccggccgttttcgggaatacccgcc

SEQ ID NO: 8669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggagttggtagacgacagcactggcatgg

SEQ ID NO: 8670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggatggaggctgctgtctcgcttgaggac

SEQ ID NO: 8671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggatgtagtcaagcgttcccataggttcc

SEQ ID NO: 8672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggatgtttgttggggtgatgaggcaatcg

SEQ ID NO: 8673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcaagtatgtcgcgtgcggtaagtagcc

SEQ ID NO: 8674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcacaatgaatgggataagatccttttg

SEQ ID NO: 8675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcaccataccacaggttccatgtgtagg

SEQ ID NO: 8676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcagtaggagatgtcacatgtcatgccg

SEQ ID NO: 8677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcatggttgacatccgcaatgggtattc

SEQ ID NO: 8678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggccgacacactgatcgtggcatccttcg

SEQ ID NO: 8679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcctaaagctctcgggaacaagatgacg

SEQ ID NO: 8680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgagggctaaaggcggcaacttgcgct

SEQ ID NO: 8681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgcatgattgcctgtttctcattgtct

SEQ ID NO: 8682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgccatcgtgggagtgcccgttgcgga

SEQ ID NO: 8683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgcgttacttacctgtttgccatcact

SEQ ID NO: 8684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgggagggtttacgtcacctacagcgt

SEQ ID NO: 8685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgggattcgctttatttggtggcgtag

SEQ ID NO: 8686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgggccaatctggggcgtggagcctcg

SEQ ID NO: 8687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcggtcacttcgatattaacgatcaatg

SEQ ID NO: 8688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgtacgctcttatcctctactgtactc

SEQ ID NO: 8689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgtcttgatcataccggggcacatgtc

SEQ ID NO: 8690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcgtgagctcaaactggctaattttcgg

SEQ ID NO: 8691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggctgcgaaggacattgcatcggatcctg

SEQ ID NO: 8692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggcttgtgggagagcaacttcggtagagc

SEQ ID NO: 8693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggaaggtcacaacaccaagttggtgcca

SEQ ID NO: 8694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggaatgaattccttgtgtgacgcgctta

SEQ ID NO: 8695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggacaattcgtcgtgcacgtggaattac

SEQ ID NO: 8696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggagcaaggatcggggttggttgatgcg

SEQ ID NO: 8697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggagcgttcttcaaagtctagagaaaat

SEQ ID NO: 8698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggaggggtgcgagcgcctggaagactgc

SEQ ID NO: 8699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggagttgagggtgggacatgcgagtaaa

SEQ ID NO: 8700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggatccgacagggcaagcgtaagccacg

SEQ ID NO: 8701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggatcttagaggcgtgttggttagggac

SEQ ID NO: 8702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggatggtgcattcgagattgtaggaggt

SEQ ID NO: 8703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggccaattagacgttcatcgggcgatga

SEQ ID NO: 8704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggcgcagttagcttaagaccttaggtgt

SEQ ID NO: 8705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggcgctctgctccactaacacctgggcg

SEQ ID NO: 8706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggcgtccgaattatcactggacttcgta

SEQ ID NO: 8707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggacaactaatcggtagagttcctgtg

SEQ ID NO: 8708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggacatgatcatggggctaccactccg

SEQ ID NO: 8709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggacgataattgttctagatctctgct

SEQ ID NO: 8710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggaggacgctttcaaggtcgcggttac

SEQ ID NO: 8711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggcaacaggcccggtgcctgtcgatcg

SEQ ID NO: 8712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggcagccggcacagaagcttcaagtcg

SEQ ID NO: 8713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggggaacacgatatgccacgggtttgga

SEQ ID NO: 8714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggggtgtgaattgagggcctccttacac

SEQ ID NO: 8715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggtacaattcgggagttcttaacccac

SEQ ID NO: 8716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggggtggtgcatcctcaagcgccatgtgt

SEQ ID NO: 8717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggtcccggctgtataggaaccctggtct

SEQ ID NO: 8718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggtcgatgttgcaatgagggcaagaggc

SEQ ID NO: 8719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggtctagcataatcggacgagggataat

SEQ ID NO: 8720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggtggctgaaagcggccacgttgtatgg

SEQ ID NO: 8721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggggtgggaggatttacctggagtgacact

SEQ ID NO: 8722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtaattggcgccacattggttagttctc

SEQ ID NO: 8723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtacgagtagggggcatcggtaacggtg

SEQ ID NO: 8724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtcagataaacaacggtattaattccgg

SEQ ID NO: 8725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtccaacacgggatctagtgcattcacg

SEQ ID NO: 8726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtccagggacgatgaggtaacccgcctc

SEQ ID NO: 8727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtcgctcggcttgttgccataggcttgg

SEQ ID NO: 8728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtcggtggcggggaaacgaggagacatg

SEQ ID NO: 8729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtcgttaatatccggtgtccgctatgcc

SEQ ID NO: 8730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtctcctcgaattgtgcttttgcttcct

SEQ ID NO: 8731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtggccgagggcggatatgaattgtcca

SEQ ID NO: 8732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtggtgcggtcgtaacttggcatcttgc

SEQ ID NO: 8733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtgtaacaactaaaccgactagtacaca

SEQ ID NO: 8734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggtgtggcaggagtgcatagtggacggtg

SEQ ID NO: 8735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggttactgtccttttcggatatgggcggt

SEQ ID NO: 8736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggttatcccatccagtgattgacgttgta

SEQ ID NO: 8737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggggttggcatagatcgggcagagcaacaca

SEQ ID NO: 8738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtaaatgcaacgtgctggtcttgtagccg

SEQ ID NO: 8739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtaacttcgactggctagtaaacactgcc

SEQ ID NO: 8740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtaagcagttgttgttctacttgctaacg

SEQ ID NO: 8741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtacacagcagcgcagttgattcttcggt

SEQ ID NO: 8742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtaggcctcgtcaataatcgcattctggt

SEQ ID NO: 8743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtatccgtgtccactaggcccaggttgcg

SEQ ID NO: 8744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtatctcccggttccagtcatgcggaggt

SEQ ID NO: 8745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtatgataagtggtaagcattggtttggt

SEQ ID NO: 8746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcaggtacatcccacctacccagatgtt

SEQ ID NO: 8747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcatgtacgatagaattccgaacggtac

SEQ ID NO: 8748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtccaggcacagtgcataatcgtccggcc

SEQ ID NO: 8749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcccgttggtgggggaatggcgtccagt

SEQ ID NO: 8750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtccggtagtgtttattcatatctggttg

SEQ ID NO: 8751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcgcatgagggctggcgtaggcacgtta

SEQ ID NO: 8752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcgccaggcagcacagttgggctttgca

SEQ ID NO: 8753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcgctcgtaggtgtatagcatgtgtctt

SEQ ID NO: 8754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcgctttctcacagcgctataagtttgc

SEQ ID NO: 8755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcgtcgattgccttatttgctggaagtc

SEQ ID NO: 8756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtcgtgaggacggccccgcgagtgattgg

SEQ ID NO: 8757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtctagcaacctcccgtccgtgcttcctg

SEQ ID NO: 8758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtctcattttacccaatgcgggagggtca

SEQ ID NO: 8759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtctggtaatggcaggaacttgggtactg

SEQ ID NO: 8760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgacttgaggggcaaaatattgattctc

SEQ ID NO: 8761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgagaatgatatgggggacggggctagc

SEQ ID NO: 8762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgagaggtgaacttgaccacgatcaatg

SEQ ID NO: 8763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgagcgaacagacgagtacgtttgggta

SEQ ID NO: 8764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgagggacacatccagtgagttagtttt

SEQ ID NO: 8765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgagggttaccgccacgttaaggttgag

SEQ ID NO: 8766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgatccgtccgtgaactgttgcgaggag

SEQ ID NO: 8767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgccttgtggagaacctgttacggtcgc

SEQ ID NO: 8768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgcggatcacatgggcagtataacggcg

SEQ ID NO: 8769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgcgggccacggactaccttagtgctta

SEQ ID NO: 8770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgcgtacggcctcccgattccatcgcgg

SEQ ID NO: 8771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgcgtgctctttatagccattcccgatt

SEQ ID NO: 8772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgcttccgtcctactgaggcggggttga

SEQ ID NO: 8773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtggaggaaccgagccactcaccatgcgc

SEQ ID NO: 8774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtggctgacggtagcagattcagcacgga

SEQ ID NO: 8775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtggttttaactttggcttttattcacgg

SEQ ID NO: 8776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgtacgttgtgcaattgcaggttcgcgt

SEQ ID NO: 8777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgtagcccgagcatactgtagcccacat

SEQ ID NO: 8778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgtaggaggtgaggaggttacgacttcg

SEQ ID NO: 8779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgtcggctacggtggttgcatgcagctt

SEQ ID NO: 8780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgtcggtttctatcttgacgctctccga

SEQ ID NO: 8781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgtgaagtctatgcgcgggtccgaccct

SEQ ID NO: 8782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgttcattgccccaacatctatggggtg

SEQ ID NO: 8783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtgttggcccaactaccatagccacgtag

SEQ ID NO: 8784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttaaagcaggtctagcaagccgtgctcc

SEQ ID NO: 8785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttactcgaattcggctcgagtgcggcgc

SEQ ID NO: 8786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttagttcagggctccgagctttaggtat

SEQ ID NO: 8787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttatcttgcgccaccaaacgggcgataa

SEQ ID NO: 8788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttcaatgttataatcgacgcggggaccc

SEQ ID NO: 8789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttcacactcttggctatggttgttcaca

SEQ ID NO: 8790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttcacgagttattagaaccacgaagtgc

SEQ ID NO: 8791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttcagatttgtttgaaaaatcgcacagc

SEQ ID NO: 8792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttgaatcgaagggctctcggttgcccgc

SEQ ID NO: 8793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttgattgagctctatcgtgccaccgcca

SEQ ID NO: 8794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttgggggctgagcggacagtgcgagata

SEQ ID NO: 8795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggtttctctggcggtttccagttattggtc

SEQ ID NO: 8796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttttccgctgcacagcagtacgtagtcg

SEQ ID NO: 8797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agggttttggtgcagtttgcatatctctgcgg

SEQ ID NO: 8798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaactcgatctccagtgccaccctgcctg

SEQ ID NO: 8799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaagattcgatcaggttgacttccgaggg

SEQ ID NO: 8800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaaggcgggcgacaaagagcacccggtgg

SEQ ID NO: 8801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaatatgcagttcagtgttatacacggcg

SEQ ID NO: 8802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaatatgccccgcgtttttgcctttcgtc

SEQ ID NO: 8803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaatcggaggtatatcagcaggatggact

SEQ ID NO: 8804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaatgaaaacaagggcaccgcgtcaggct

SEQ ID NO: 8805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacaagagcggtaccgtctgttgtccatg

SEQ ID NO: 8806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacaatggggccactcgtcgtgatcaatt

SEQ ID NO: 8807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacagcgtttgagacctcgagccattggg

SEQ ID NO: 8808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacagtggaaaggtataggtttgcatgcg

SEQ ID NO: 8809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacatgtcatttcgtgtcattctcaaccg

SEQ ID NO: 8810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaccaggcgcacatgacgcagctaacgcg

SEQ ID NO: 8811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacccggccgataactcgtgtggacactt

SEQ ID NO: 8812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtaccttggattcgttcagcggatcactcc

SEQ ID NO: 8813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacgaataggagaccgatatctactcacc

SEQ ID NO: 8814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacgcttcacggggtttggtagagaattc

SEQ ID NO: 8815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacgcttctgataggggttgcctagcctc

SEQ ID NO: 8816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacgggacaaccagacacctttttacgag

SEQ ID NO: 8817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtacttatattgcttcatcacattgcatgg

SEQ ID NO: 8818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagagcaccttcatggagaaccgtggcgc

SEQ ID NO: 8819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagagggttcaggcaggctctcccgtgtt

SEQ ID NO: 8820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagaggtatacagtgacaggacctcggtt

SEQ ID NO: 8821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagaggtggcgcgaattgtccccctctca

SEQ ID NO: 8822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagatgataccacaaccatatgcgcaaga

SEQ ID NO: 8823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagatttgtacacttcaagagagttttcc

SEQ ID NO: 8824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagcaaagtagtatcagaatagtcgtgca

SEQ ID NO: 8825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagtaaactactacgccactcgtttcgca

SEQ ID NO: 8826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtagtgtgtgccaatgaggacaatttataa

SEQ ID NO: 8827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtatcggctttatacggtatggatatgacg

SEQ ID NO: 8828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtatgcccagcaccccacagataccgttca

SEQ ID NO: 8829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtatggtcttattgcaccttttgtcgcgtc

SEQ ID NO: 8830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtattggccaagttcacagtcggtgtgagg

SEQ ID NO: 8831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcaaaaagcgaattcaatagtaaagccgt

SEQ ID NO: 8832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcaaaagccgtaatcacagaggtttttaa

SEQ ID NO: 8833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcaacaggggggtatgattcttctaaggt

SEQ ID NO: 8834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcaagcgggaaggatagacgaccgcagca

SEQ ID NO: 8835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcacacgtcctaacacgaagcctcgcatg

SEQ ID NO: 8836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcaccccattattagggagtatcagggta

SEQ ID NO: 8837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcacggtcatagagactcggcggcgtcat

SEQ ID NO: 8838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcacgtccgctcgttctcttaatgtaaag

SEQ ID NO: 8839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcactaaactttcggcacaccgggtcact

SEQ ID NO: 8840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcactataacgagcgcgagggcaataccg

SEQ ID NO: 8841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcactgtcgcgcggaacgctaactctccc

SEQ ID NO: 8842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcagacgtaactttacggcttcaccagca

SEQ ID NO: 8843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcatgaaatcgtacaattatagacccgct

SEQ ID NO: 8844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcatggtcattaatgtggaatctgcaggt

SEQ ID NO: 8845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccaactgtagtgggattttagagtgtgc

SEQ ID NO: 8846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccacaacacaagttagtaacgcttcact

SEQ ID NO: 8847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccaccgttgaatcgtggtagcctgtctc

SEQ ID NO: 8848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccctctgtttttctcgtgcgctgttggg

SEQ ID NO: 8849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccgaggctaggtcctgttgctatagcct

SEQ ID NO: 8850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccgcaaggtcaacgcgtgtgcaatgtgt

SEQ ID NO: 8851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccgctggccccccatttcatgcgtgagg

SEQ ID NO: 8852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccgctgtgcgcatagggttaaatcgttt

SEQ ID NO: 8853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtccgtacgtttgcctatggggatgtacgc

SEQ ID NO: 8854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcctacaacgtaatgctaatgcgggcacg

SEQ ID NO: 8855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcgagaaactacgaagacttatgctgact

SEQ ID NO: 8856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcgagctgtgctcacagcagagaatggcg

SEQ ID NO: 8857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcgatagaacactccacttggtgcgactt

SEQ ID NO: 8858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcgcggatctcaacggggcgccgacgatc

SEQ ID NO: 8859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcggcccaggaagttcatgttgtctcttg

SEQ ID NO: 8860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcgggaagggagagtcacatatatccggc

SEQ ID NO: 8861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcggggaacgaaaccatagtccggatgat

SEQ ID NO: 8862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcggggcagtgtgcacttctatcattgtt

SEQ ID NO: 8863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcggtaacggctagggccattggacacgg

SEQ ID NO: 8864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcggtcgttgccctttccttgcccgtacg

SEQ ID NO: 8865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcggtcttaagagagagtgttgtccactc

SEQ ID NO: 8866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtctaacgatcgcttctaaggaacttgcct

SEQ ID NO: 8867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtctcagcgtgggcttgtccgtatgatgtg

SEQ ID NO: 8868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtctgaagattgactgattttacgcgtatc

SEQ ID NO: 8869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtctgccgggtgatattaggcgtaagtcct

SEQ ID NO: 8870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcttacacatcatcggccggtccaaatga

SEQ ID NO: 8871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtcttttcgcaaaggccatgacaactatcg

SEQ ID NO: 8872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgaaaccgcacccgtcaatggcaattccc

SEQ ID NO: 8873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgaataccctgggtaggttgctcgcgact

SEQ ID NO: 8874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgacgtaggacgggcggaatgaaggggta

SEQ ID NO: 8875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgacgtgttcacattccaggggcactgca

SEQ ID NO: 8876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgactgggcaaagcaatggtggcggcctg

SEQ ID NO: 8877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgactttgccattcgtcaggagaacacgg

SEQ ID NO: 8878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgagataccgacctcgatcagtgaatgta

SEQ ID NO: 8879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgagtacgggatggccagggctagactgg

SEQ ID NO: 8880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgagtggtcttttacattcgacgaggtgg

SEQ ID NO: 8881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgataggcacgttgtaattttcctcccca

SEQ ID NO: 8882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgatcttttgtgtgagacttgctggcttc

SEQ ID NO: 8883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgatgttatgccgacaatgcttcaatccg

SEQ ID NO: 8884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcaacatcttaacgaccgtctagcggga

SEQ ID NO: 8885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcaatcgtgtctcgagtcatatcgcaat

SEQ ID NO: 8886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcacctgcgacaggcgtacagccccaat

SEQ ID NO: 8887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcagcttggcaactgcctatttctttca

SEQ ID NO: 8888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcaggatcccttatcagcgcggttcgta

SEQ ID NO: 8889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcaggcctttgaatcccattgtagttgt

SEQ ID NO: 8890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcaggtcgtctgctcttttcccggtggc

SEQ ID NO: 8891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcatcatttgctcatggtgcttcgcatc

SEQ ID NO: 8892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcatgttgaggatcgcatgtgttgcccg

SEQ ID NO: 8893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgccacctggtacatgatgtcttgcgttg

SEQ ID NO: 8894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgccatctttcggtatttcgagctaaatg

SEQ ID NO: 8895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgccccaaggatcctacgctaagggcttg

SEQ ID NO: 8896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcctcagccggcattgtggggttgcact

SEQ ID NO: 8897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcctcatccaacggcattgcgctcctca

SEQ ID NO: 8898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcgaacttcaccgcagtccttcttcagg

SEQ ID NO: 8899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcgacagttttgtaatggcataatgtaa

SEQ ID NO: 8900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcggggaaatgaagtctatatgaacgca

SEQ ID NO: 8901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcgtagtagaaggcattaggccgggatc

SEQ ID NO: 8902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgctattttatatccccgttagtaatcat

SEQ ID NO: 8903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgctcgctgcatttgggctctgaggtgct

SEQ ID NO: 8904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgctctggacagtgacgggtgctgagtag

SEQ ID NO: 8905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgctggctttggtatttttgtttttggtt

SEQ ID NO: 8906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgcttctgttccttatctacaagtggtgc

SEQ ID NO: 8907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggaacaatattggcgatctcacaccggt

SEQ ID NO: 8908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggaccggtcgcttggcccgtagtctggt

SEQ ID NO: 8909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggatcgcaaacgtggatcgctttatttc

SEQ ID NO: 8910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggattgtcttccctagatcattcctttt

SEQ ID NO: 8911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggccgaacagatgcgtattgcccctggg

SEQ ID NO: 8912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggcgcgcaggagggtggcaagattcgtc

SEQ ID NO: 8913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggcggaaggattcgttggttccgcgcgg

SEQ ID NO: 8914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggcggccccagctatacatgcaagtgtg

SEQ ID NO: 8915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggcggggcgctatacaacccagttcgtg

SEQ ID NO: 8916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggcggtagctcttcgatgggcagctgcc

SEQ ID NO: 8917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggctatcgtcccgcacgctcgtcacagg

SEQ ID NO: 8918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggctcggttgggtatcgtcgggttaaag

SEQ ID NO: 8919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggaacagtgcggtccctctcgcaccga

SEQ ID NO: 8920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggaacgatgttcagttgagtaacatgg

SEQ ID NO: 8921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggagccagaatttagcgtcgttagctg

SEQ ID NO: 8922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggatagggtgatggactggtctgcctt

SEQ ID NO: 8923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggatctgggagcggccgtcataggacc

SEQ ID NO: 8924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggcgcacgtattacctttgccaggcgc

SEQ ID NO: 8925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggggcatgtacgcgcgggctctcctgac

SEQ ID NO: 8926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggggcgtgcaggaccgacgtgattggcg

SEQ ID NO: 8927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggggatgagttcttcgacattctgagg

SEQ ID NO: 8928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggggggtctggagtaattcttggctcgc

SEQ ID NO: 8929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggggttgtcttggagtcttgcgccgctg

SEQ ID NO: 8930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggtccacgttttgtagaaccgtaacat

SEQ ID NO: 8931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgggttactgcgccggtggtaggtgttgt

SEQ ID NO: 8932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggtctcggtggcctactagctgttcgtg

SEQ ID NO: 8933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtggtgcggctaaccaatctccctaagttc

SEQ ID NO: 8934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtaatcctcggtggacttaacctctgcc

SEQ ID NO: 8935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtacggaaggactcttttgctccgggag

SEQ ID NO: 8936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtagcctgcataagtaaagtgcagctcg

SEQ ID NO: 8937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtagcgcacggacggcgaatactatcgg

SEQ ID NO: 8938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtcccagtttattgttcccacgggcgcg

SEQ ID NO: 8939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtccctctacaatccgcggagccctaca

SEQ ID NO: 8940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtcgactctgttacaggccagctggtta

SEQ ID NO: 8941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtctgcggcgctgctccagcgtttggac

SEQ ID NO: 8942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtgcctctatctgttcaggagtagctca

SEQ ID NO: 8943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtggaaacgccatcgcttacacgtctga

SEQ ID NO: 8944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtggtttataaggctcggttcgtcatct

SEQ ID NO: 8945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtgttcaaacccgcccaggcttgtgccc

SEQ ID NO: 8946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtgttgaacatgtggtcttgacttagga

SEQ ID NO: 8947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtgtttcccgagtcgtggatgactgtcc

SEQ ID NO: 8948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgttaggacacctgctactctgtttaatg

SEQ ID NO: 8949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgttaggctttgtgatatacggggggacc

SEQ ID NO: 8950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgttcatttgaattgcggattgggacgag

SEQ ID NO: 8951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtgtttgctttacttaaaccttgctcgacg

SEQ ID NO: 8952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttaattgttgtgtttaacgcttgtttcgt

SEQ ID NO: 8953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttacgcggcggtgggtggctcgtaatggc

SEQ ID NO: 8954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttacttaaattgggtcaaaacaaacgatc

SEQ ID NO: 8955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttagacccaagactcgcgccaacatcacg

SEQ ID NO: 8956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttagcctgctcgaacggtctccggcgtca

SEQ ID NO: 8957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttagtagctgatctggggtggggctgcta

SEQ ID NO: 8958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttatcagcggaagtctgtgctccttaata

SEQ ID NO: 8959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttatctcagtagctctagattgttttcga

SEQ ID NO: 8960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcacataccggtatgcgttcagtgccgt

SEQ ID NO: 8961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcagttctctaactgtcacgatctcact

SEQ ID NO: 8962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcatacttgacgagtggtccgttttgat

SEQ ID NO: 8963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcatattgggtaaacagcttccctcttc

SEQ ID NO: 8964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttccccatgcgactactctccgctgcatc

SEQ ID NO: 8965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcctgcctcccagtgaagatacggtcaa

SEQ ID NO: 8966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcgatagcggattagctgcacaccgcgt

SEQ ID NO: 8967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcggcatcgcggattcgaactcacgtcg

SEQ ID NO: 8968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttcgtcccgtgagcacactggttaacttc

SEQ ID NO: 8969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgaatgcgccgtcttgggcgtgcatgcc

SEQ ID NO: 8970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgacgggaggggtttgtgttatgcgctt

SEQ ID NO: 8971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgactcgttttaagttggtccacgctgt

SEQ ID NO: 8972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgcagtctggtcagtcttcgcagtggag

SEQ ID NO: 8973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgcgaggactgggtgtatctctggaatt

SEQ ID NO: 8974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttggaaacggcaatgattctgcccgtacg

SEQ ID NO: 8975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttggaatgattgtgcatgcactcaatata

SEQ ID NO: 8976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttggaggcgagcggtatgtttaaaagtgc

SEQ ID NO: 8977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttggccggggacttggaaatgcctctaat

SEQ ID NO: 8978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgggagggtacgaataggacacgatggg

SEQ ID NO: 8979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgggctctaggctggcagattattacac

SEQ ID NO: 8980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgggttacgacggtggcatccatgcggg

SEQ ID NO: 8981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgggttctacccaaaacctgctgtgagg

SEQ ID NO: 8982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttggtcctcgttcgcgttatgtagttatc

SEQ ID NO: 8983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttgtgtacgttgtgacttaggttgcgtgc

SEQ ID NO: 8984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtttaactcggacaaaacggggtgggtgga

SEQ ID NO: 8985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtttagtcgtatcggcgacgaactgtaccg

SEQ ID NO: 8986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtttcattggatgtactcttggatgactgt

SEQ ID NO: 8987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtttcctcaacgtattaatatttgcgtagg

SEQ ID NO: 8988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtttctcaacgagctggtcacagcctgtcg

SEQ ID NO: 8989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtttgcgtgtgtactcatcgtaaatttatc

SEQ ID NO: 8990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggtttggatgttatttcttttacttcgtgca

SEQ ID NO: 8991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttttatagtgcaggttctcgacgctcttc

SEQ ID NO: 8992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
aggttttctacgggcggaggaaagttttggcc

SEQ ID NO: 8993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaaacgaagacttggaccggatccgggcg

SEQ ID NO: 8994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaaagcaacgctacgactaacgttcttgt

SEQ ID NO: 8995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaaagggtaacacgagggcttccctcccg

SEQ ID NO: 8996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaacgagcacctactctaataggccctga

SEQ ID NO: 8997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaacgcgaggactgtggagttaggcgact

SEQ ID NO: 8998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaagacagtagcattgttaccaggggctc

SEQ ID NO: 8999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaaggggcgggagatacgaggaccttggc

SEQ ID NO: 9000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaagtcgtaattgagttctatttttcctg

SEQ ID NO: 9001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaacataatgttcggaccgccggctctggt

SEQ ID NO: 9002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaccactcaatagatgctactgcgggacg

SEQ ID NO: 9003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaacgtacggagtattactctctatttacg

SEQ ID NO: 9004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaactctcgcgtttattttctcccctcgtg

SEQ ID NO: 9005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaagattggttctgcggtgattggcggtcc

SEQ ID NO: 9006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaagccgtcagtggaacggatgtgaattat

SEQ ID NO: 9007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaagcggttctacttgagaggttttcccat

SEQ ID NO: 9008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaaggcctccatgttagacttgtaaccggg

SEQ ID NO: 9009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaatcaaggcatggggtggctctcgctgct

SEQ ID NO: 9010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaatgctggcggttcctctagtgcagctta

SEQ ID NO: 9011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaatgtctctgttcctacgtgagcaggtcg

SEQ ID NO: 9012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaattgtaaccgcgtttgcctggtgagtcc

SEQ ID NO: 9013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacaaaggcgtctttttggatccggaatgg

SEQ ID NO: 9014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacaccgacacgaattgtcagtgcgtagtc

SEQ ID NO: 9015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacaccgacgcgcgaaccggtggggggatt

SEQ ID NO: 9016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacactcaacggttggacagagtcggcagt

SEQ ID NO: 9017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacagataaacgtaacctgaactcggtgct

SEQ ID NO: 9018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacaggcggtttgccttggttcacgcgcgt

SEQ ID NO: 9019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacaggtgttgtggacgttttctcgcttgt

SEQ ID NO: 9020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacagttagatttcgtctaggatcgcttag

SEQ ID NO: 9021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacatcgatctttcgaactacctaccgaac

SEQ ID NO: 9022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaccacccatggccgagcggcagtactatc

SEQ ID NO: 9023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaccagatccatcataaagtacctagatag

SEQ ID NO: 9024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacccggacttcctgtacagcctgcatcgg

SEQ ID NO: 9025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaccgcgataccggctggtgggtgacaagc

SEQ ID NO: 9026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaccgtcatttggttcgcgggtagcacctc

SEQ ID NO: 9027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaccgtcgttctcccctgcgaaccgttagt

SEQ ID NO: 9028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacctaatcatgcccgcagttctgtggatt

SEQ ID NO: 9029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacctccgcagctagggcatgacaaaaagg

SEQ ID NO: 9030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacctgagggcttacgcaaggctattcatc

SEQ ID NO: 9031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacgctcggctcacgtggaagctgaccctg

SEQ ID NO: 9032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacggcggggatcgctctccatgttttgca

SEQ ID NO: 9033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacggctagtaaaagttatattcgaatcat

SEQ ID NO: 9034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacgggtatctctcacggtcaggctacgtc

SEQ ID NO: 9035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacgggtgagtgtgcggagtattttcggac

SEQ ID NO: 9036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacggtattggcggatcgggttggctgtga

SEQ ID NO: 9037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacggtcatggagattggttagtagtggta

SEQ ID NO: 9038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacgtaagctgaagtcaggccctaacagtc

SEQ ID NO: 9039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtacgtggtgggcggtggggggtcaactgcg

SEQ ID NO: 9040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtactacgacggtctcaggatacgtatggcg

SEQ ID NO: 9041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtactttgcggccatggttaaactttaggtg

SEQ ID NO: 9042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagactagacttgcaagcacaggatcgcgg

SEQ ID NO: 9043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagatcattcgggatgtctcaatcatttcc

SEQ ID NO: 9044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagatctcaatgatcatgttccacgtataa

SEQ ID NO: 9045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagattaccccggcctgaaccctcccggtt

SEQ ID NO: 9046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagatttgttgcatataagtgacttacctt

SEQ ID NO: 9047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagcaaacgtatgctcgtccctctgcaacc

SEQ ID NO: 9048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagcggtgtgggccatgccgttcaattagg

SEQ ID NO: 9049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagcgtcgttgtatatcccctctagtatga

SEQ ID NO: 9050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagcgtgcctgctgcccacggactaagtcg

SEQ ID NO: 9051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagctccatacggacttgagtgatccgaat

SEQ ID NO: 9052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaggacgttatcgggcacgctgacaccttg

SEQ ID NO: 9053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaggacttctatcgcggtcgcctgtccttc

SEQ ID NO: 9054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaggaggctgcgcattccttgttttggatg

SEQ ID NO: 9055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaggcgtagatctggtgggtcggttgcttc

SEQ ID NO: 9056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaggcgtgtggctcctatgtgtcggacttc

SEQ ID NO: 9057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagggccacaacacgtattcgcgcttcggg

SEQ ID NO: 9058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtaggtcgtacgtctcggtcattcaccttgc

SEQ ID NO: 9059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagtcatctgattagctccagcgcaagtgg

SEQ ID NO: 9060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagttgtgagcttgtactactgtgggcgtg

SEQ ID NO: 9061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtagtttgcaggtttgcgtttcattggtctg

SEQ ID NO: 9062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtataattgggaatgatgttcgacaggtgac

SEQ ID NO: 9063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtataggtcttattctatatatcaaggaaag

SEQ ID NO: 9064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatatcgcgttggaactcttgaggatcgtt

SEQ ID NO: 9065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatatgccccgatcctggagcacggcgtgt

SEQ ID NO: 9066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatccacgcatgtgaggagaattacttacg

SEQ ID NO: 9067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatcgcggtaaaggacgcgcttcggccgaa

SEQ ID NO: 9068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatcggccacttatcttgactgtaggtcgt

SEQ ID NO: 9069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatctctgggtcacttcttctttaatctga

SEQ ID NO: 9070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatgcaaatcacggttgcagcaccgggagt

SEQ ID NO: 9071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatggactcactgcggacagcgcgtgccgg

SEQ ID NO: 9072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatggcgaccattctatgtctacgcgatgt

SEQ ID NO: 9073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatggggggacgggtgctcctttgacttgg

SEQ ID NO: 9074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatgggttcgcactgagagttcagactgat

SEQ ID NO: 9075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatggtaatcgaatttgtgttgggcgggat

SEQ ID NO: 9076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatgttttcaatttatttggtcattcggtc

SEQ ID NO: 9077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtattagaaggcgatggtcgccatattggcc

SEQ ID NO: 9078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtattcgatagtggttaactccgatttattc

SEQ ID NO: 9079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtattcgcactgtgcttccagctcgcgtcca

SEQ ID NO: 9080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtattcgtttcgctggcctgaacaacccgga

SEQ ID NO: 9081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatttaaactccctgcagatttgtttgcgt

SEQ ID NO: 9082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtatttggtgtcatggtggaaaattcggaca

SEQ ID NO: 9083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaaaagtcgaacataatatgtatgaacga

SEQ ID NO: 9084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaacagggtctacgattgcggaagaggag

SEQ ID NO: 9085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaacaggtgtaatctgacaatgaggcggt

SEQ ID NO: 9086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaaccgtcggggcccacgatggtcactgg

SEQ ID NO: 9087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaacgacaatactcgtactggtacattgg

SEQ ID NO: 9088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaacggaattccacgttgtgctgtgtggc

SEQ ID NO: 9089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaagccctcacgtggaatcggagcgctcg

SEQ ID NO: 9090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaagcgtaatggatgccacccgcgtgcta

SEQ ID NO: 9091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaagcgtgcggtcaacaagttgcgccgta

SEQ ID NO: 9092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaagggtatcaggacttgataatgcgcca

SEQ ID NO: 9093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaagtggcgttgtagtccggtgcgtgtca

SEQ ID NO: 9094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaatgctcatcgagatcaacagaaggttt

SEQ ID NO: 9095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaattccggtcgggtacagagactcgttg

SEQ ID NO: 9096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcacatccattctgactaggtccgacctct

SEQ ID NO: 9097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcacctctagaacgtatacgatcgccgtag

SEQ ID NO: 9098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcacgcgccaggaactttttgtactcgttt

SEQ ID NO: 9099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcacggcattcgagtcgcggatacccgtta

SEQ ID NO: 9100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcacggcgttagttttgtactctggttctt

SEQ ID NO: 9101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcacggctcggcttgggcgcgcaaaaacga

SEQ ID NO: 9102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcactccacactgcaccgcaggttgctggc

SEQ ID NO: 9103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcagcggcagttgaactcacttgttcggct

SEQ ID NO: 9104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcagcggtttgggagtgtggttcagcgttg

SEQ ID NO: 9105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaggagggatacgcagtccttgctatgat

SEQ ID NO: 9106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaggcaatctgtgttgacactccagtgcc

SEQ ID NO: 9107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcaggtgtccgcggtcttggctgcacgcta

SEQ ID NO: 9108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcagtccgcctatgtctgcgggaagacgtg

SEQ ID NO: 9109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcatagaggcatggagttatttgcggcaat

SEQ ID NO: 9110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcatagatagctccggacgtactgcgaacg

SEQ ID NO: 9111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcatcgctagcgttcttcttgactcgcccc

SEQ ID NO: 9112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcatcgtcatggcatgtactaaatgggtgg

SEQ ID NO: 9113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcatgcctctcgaatccttaggtgatgccg

SEQ ID NO: 9114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcattatagcttttcactcgtttagcacgc

SEQ ID NO: 9115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcattccctagtcgggaggatcgccgtggc

SEQ ID NO: 9116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccacaatgcacactgctgccacgggtgtg

SEQ ID NO: 9117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccagaaggaggaccggtcgtgtgaggccg

SEQ ID NO: 9118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccagatttagtcgtttggcgagggccaaa

SEQ ID NO: 9119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccagtcccttatcgtgatctagacttttg

SEQ ID NO: 9120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccataggaacgtttgcggttggcatggct

SEQ ID NO: 9121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccattagacgttcacccgctcatacagtg

SEQ ID NO: 9122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcccactcgtgccggttaggtgtcggtgtg

SEQ ID NO: 9123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccccctcccccactgatacggtctttgga

SEQ ID NO: 9124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccccgccttttactgtaggtgcgttcctc

SEQ ID NO: 9125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcccgagttattggaggaatcagctactat

SEQ ID NO: 9126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcccgtaggtagattgccaggccagaagga

SEQ ID NO: 9127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccctaaagggatcaaatcatctgtgacac

SEQ ID NO: 9128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccctctgatccgcctcgtgcccggtaagt

SEQ ID NO: 9129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccctgacccgagccctgtcgatgtatggt

SEQ ID NO: 9130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccctgcgtgagggcggtttcgatactcga

SEQ ID NO: 9131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccgagaggaacccaccggttagcagcggg

SEQ ID NO: 9132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccgaggatgggtgttacgaccggtggtgg

SEQ ID NO: 9133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccgagttgagggtaggtctgctataatcg

SEQ ID NO: 9134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccgctgccgtacgcagtatgtacacgtcc

SEQ ID NO: 9135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccggatgttcttttagagagggggcagta

SEQ ID NO: 9136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccggcgacggctagcactgcggcacgttt

SEQ ID NO: 9137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccgggggatacttttagcctgcggggatg

SEQ ID NO: 9138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccgtcacagtttatggggggcgtgtctgg

SEQ ID NO: 9139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccgttgtggggtggaggtaagcctgatag

SEQ ID NO: 9140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcctacatgcgatgggtaaagtcattgggg

SEQ ID NO: 9141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcctatggcctactttgcggggacgcctca

SEQ ID NO: 9142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcctcgcaacgtgcagttaagtaggagcca

SEQ ID NO: 9143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcctcgtccaattagatccgatcggtgcaa

SEQ ID NO: 9144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcctgtgtggctctcatgacccggttgtgg

SEQ ID NO: 9145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtccttaactcttgaacattattttgaacat

SEQ ID NO: 9146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgacattaaattgccgcaggccttaggac

SEQ ID NO: 9147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgacttagtacgcgtgtggtattagtcca

SEQ ID NO: 9148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgagtgtagaaggtgtcaatccaggtcgg

SEQ ID NO: 9149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgatggcgagcggagaaggcctggagcgg

SEQ ID NO: 9150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgcctaaggagaggaagtcttgcgactcg

SEQ ID NO: 9151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgctaacatcgaggcctgatttgcccgcc

SEQ ID NO: 9152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgctattgttggaatttagatgtcatggt

SEQ ID NO: 9153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgcttaattcatcctaagcccaaaaagtc

SEQ ID NO: 9154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcggacattggtccagctcgtttcggcacc

SEQ ID NO: 9155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcggagggtaacgccccacatatggcttgg

SEQ ID NO: 9156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcggatcgacgggaacgggcgtatatggac

SEQ ID NO: 9157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcggattttccgtccctcacggttgcctct

SEQ ID NO: 9158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcggcagcagtggaagggttcgttacggcc

SEQ ID NO: 9159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgggagcagtagaactaaccttcggtatg

SEQ ID NO: 9160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcggggcactggcttggcgcactagggggt

SEQ ID NO: 9161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgggggtccaccgtgggaagttgtcaccg

SEQ ID NO: 9162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcggggtagtgtcaacctgagggcctgtca

SEQ ID NO: 9163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgggtaaacgggttaatatatggtgccac

SEQ ID NO: 9164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgggtcgatgcaggagtgggtttgtgagc

SEQ ID NO: 9165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcgtcactttgtgattagttactctagttc

SEQ ID NO: 9166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctaatgccaaatttgtgctactcgcgtac

SEQ ID NO: 9167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctacttgcaagattcaacaatctgacccg

SEQ ID NO: 9168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctacttgctacttcgctattgttaatatc

SEQ ID NO: 9169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctagcggcaaatctttagggcagcttgac

SEQ ID NO: 9170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctattggggatcctccaccgccacgctca

SEQ ID NO: 9171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctcacttacgcgcgtccgaatgctaggtc

SEQ ID NO: 9172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctcaggaatatacatggagtacaacaacc

SEQ ID NO: 9173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctcatgcgcgtaaggacatcttcatgagt

SEQ ID NO: 9174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctccggacgtctgtgcactctagtcttcg

SEQ ID NO: 9175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctcgagaggtagcggtcaaagaggtagac

SEQ ID NO: 9176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctctgtgattcgcgcgcaacggggacacg

SEQ ID NO: 9177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctgaggtttcaacgactctctcgggttcc

SEQ ID NO: 9178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctgatcatggtttctgtggagtgttttgt

SEQ ID NO: 9179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctgtagggaagggagtggccggccgggga

SEQ ID NO: 9180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctgtatgcacagcagattttggcatgggc

SEQ ID NO: 9181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctgtggacggtgtctccttatgtacccgg

SEQ ID NO: 9182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctgtggtcacgcatgctacagtttgcctc

SEQ ID NO: 9183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctgtgtgcatgttcggaaagttctgtgtt

SEQ ID NO: 9184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcttatgagtttgtcatccgtaattggaac

SEQ ID NO: 9185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcttgacatcgtatgcagcattcgctaagg

SEQ ID NO: 9186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcttgatggcttatgataaggcaccaagaa

SEQ ID NO: 9187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtcttggcagccttgtaaggtacttcatcga

SEQ ID NO: 9188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtctttattggtcattagccgtgagggttaa

SEQ ID NO: 9189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaaatggcgtgtcagagcatagtctccac

SEQ ID NO: 9190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaacaacgctctgtgctcatagtattaaa

SEQ ID NO: 9191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaacgtgttccgacttcttgcgtatatta

SEQ ID NO: 9192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaaggtccatgcatcaacgactcctcctg

SEQ ID NO: 9193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaagtgctgcatgacaaacctacccgagc

SEQ ID NO: 9194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaattcttgtgcggcatcactgcgtgttg

SEQ ID NO: 9195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgacaacaaaaaggactccccttgttcttg

SEQ ID NO: 9196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgacaccagtttcgacttgcaggcatcctc

SEQ ID NO: 9197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgacactaatggcggccacttctccactcc

SEQ ID NO: 9198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaccaaactatttgtctccatatccttca

SEQ ID NO: 9199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaccggaagtgcatacacatctgggctgt

SEQ ID NO: 9200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgacgcgaccagttgcgcctcgcccaaatt

SEQ ID NO: 9201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgacggacccaggtggtgtcccttgaccac

SEQ ID NO: 9202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgactctccctcgctcctgacgagtataac

SEQ ID NO: 9203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgactgctttttatggcgctcatggtcatg

SEQ ID NO: 9204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgagacatggtgccagatcagcggggcacg

SEQ ID NO: 9205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaggacaatcagcgctcatcgcgtaggcc

SEQ ID NO: 9206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgaggcatatccaccaagcagttatttgct

SEQ ID NO: 9207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgagtatacactgtttgagcaataaggatt

SEQ ID NO: 9208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgataaattgaggtggggttcagtgtacct

SEQ ID NO: 9209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgatacggattggggtgcgggcgtttcgct

SEQ ID NO: 9210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgatatggtgacaaatggcagtggcgagtg

SEQ ID NO: 9211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgatcacgtgggagaccggtagcatattta

SEQ ID NO: 9212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgatccgggactgacatttgcccttgttgc

SEQ ID NO: 9213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgatcgagagtggttgtgtcggtatagatg

SEQ ID NO: 9214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgatgtacacgaccacccgggcatcctttc

SEQ ID NO: 9215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgattgcacgcgactttactagttttctgt

SEQ ID NO: 9216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgatttgacttgacaccaccatccgtcaac

SEQ ID NO: 9217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcaactgccaacgtccaaactgatgtggt

SEQ ID NO: 9218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcaagaaacctagtgtccatcttgattat

SEQ ID NO: 9219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcacatttgaagtttaactcagcgaatac

SEQ ID NO: 9220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcaccaactgtatgattttcacgtggtag

SEQ ID NO: 9221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcaccctgggccccgttatggctatactt

SEQ ID NO: 9222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcactatgcaaccgggtttcggagtaaga

SEQ ID NO: 9223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcactccttcatttagtggggtttcgatt

SEQ ID NO: 9224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcagccatgatatccacgtgtttgccctt

SEQ ID NO: 9225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcaggtaatcctcccaacctaaacagtct

SEQ ID NO: 9226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcatagcgatacgtttcgccgaccttgcg

SEQ ID NO: 9227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcatccgcggtgagtcacaagagtggacg

SEQ ID NO: 9228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcatggcccatctgaagatgatagctttg

SEQ ID NO: 9229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcatgggtccgataaaaggggtctagcct

SEQ ID NO: 9230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccaatggtcggtgcgggcatgaagtggt

SEQ ID NO: 9231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccagacgcctgtctcctgtacgagtgct

SEQ ID NO: 9232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccatcaacgctgttcgattacaaggtcg

SEQ ID NO: 9233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcccaccgggatcatgtcgtttgccttcc

SEQ ID NO: 9234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccccggtataggtggcgaacagggctgg

SEQ ID NO: 9235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcccttgggatataaagtctctcgccgaa

SEQ ID NO: 9236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccgctatcagaccgtctataagatagtc

SEQ ID NO: 9237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccgggtgaatgcagcaatctattgacct

SEQ ID NO: 9238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccggtgatcgtaccagtattgtgacatc

SEQ ID NO: 9239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccgtaatgcacgggggtggtatgctcgg

SEQ ID NO: 9240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccttattcgacgctcggcatgacctggg

SEQ ID NO: 9241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgccttattcggaatcccttatcgggggtt

SEQ ID NO: 9242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgaaagtttacgagttccatatccctca

SEQ ID NO: 9243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgaagggcgtaaggctgaaggcaccgtt

SEQ ID NO: 9244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgaaggtcatcacttcatattgaaaccg

SEQ ID NO: 9245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgacgccggtccgattgagttcggaggt

SEQ ID NO: 9246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgagtgtggctcaagcgcaagctaacca

SEQ ID NO: 9247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgatgagcatgggacaatccccctagca

SEQ ID NO: 9248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgattgggcggcttatctctaactcttg

SEQ ID NO: 9249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgcatagcgggacgtgtgaattactggg

SEQ ID NO: 9250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgccactcggcacaggtagctagttttt

SEQ ID NO: 9251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgcgcatgccttggttggtaggacagcc

SEQ ID NO: 9252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgctacgaattggtcaaggatccaggtc

SEQ ID NO: 9253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgggaatagtacggcctctcgggatgtg

SEQ ID NO: 9254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgggacccactcaagtttccgtcagctt

SEQ ID NO: 9255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgggagatcgagcggtgagcttggaggg

SEQ ID NO: 9256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgggaggtccgggcagtggcatagaggc

SEQ ID NO: 9257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcggtctagaggtatgcctggggggggcg

SEQ ID NO: 9258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgtgaacgtgccgcgatccgaaagagcc

SEQ ID NO: 9259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgtgaccgattcatgggtggagttgtcg

SEQ ID NO: 9260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgtgggtcaacagctcaccgcggtggcg

SEQ ID NO: 9261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgttagggtggtggtgggttccaagcca

SEQ ID NO: 9262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgcgttatcgcgaaagctctctcgggcggc

SEQ ID NO: 9263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctcacgggctaattggactcgtttcttg

SEQ ID NO: 9264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctccggcgactgatcggctcggggtggc

SEQ ID NO: 9265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctgacagctgacagggtaagatactccc

SEQ ID NO: 9266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctgatcatcgcgattagcgtattgcttc

SEQ ID NO: 9267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctgcagtcttggatgcccggagacacgg

SEQ ID NO: 9268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctgccggtgctgtcatggcacgtatacg

SEQ ID NO: 9269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctgcggtccgcttccaaggaattgttta

SEQ ID NO: 9270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctgctgaggggaggatggagggcgtact

SEQ ID NO: 9271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgctggagagaacggggtgtcaggaatagc

SEQ ID NO: 9272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggaataagcctctacttgccattcccgat

SEQ ID NO: 9273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggaatctctcgatgtgtttatatccgttc

SEQ ID NO: 9274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggaccaagccataacaagtgcgagggggc

SEQ ID NO: 9275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggaccgtccatctccatgagtatttgggt

SEQ ID NO: 9276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggacgcgggtactcgtggatgcgtagtag

SEQ ID NO: 9277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggacggcccatcgacgtcgcatcacttct

SEQ ID NO: 9278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggactatgaaggggcttttcttcatcccg

SEQ ID NO: 9279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggagaatattgacctctgatattaggcgc

SEQ ID NO: 9280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggagactctttagacaagtttggagtcgc

SEQ ID NO: 9281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggagctcgttgaaggaggaaacctcaggg

SEQ ID NO: 9282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggaggaggagcacacgcgtccgcgtttgg

SEQ ID NO: 9283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggatgtaattcgtttcctgtacctggcgt

SEQ ID NO: 9284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggcacatctgttgtaatttctgcatggcg

SEQ ID NO: 9285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggcacggcattggctctatttcgggtgcg

SEQ ID NO: 9286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggccagttcttgaatcggcgcaaccgtaa

SEQ ID NO: 9287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggcccggatcccgtctttggagcagcgat

SEQ ID NO: 9288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggccgcggacataatcgttacttgtgccc

SEQ ID NO: 9289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggcgacaagttaggttgaactgttcgatt

SEQ ID NO: 9290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggcgattggaggcgtttacggtagtattc

SEQ ID NO: 9291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggcgccagcggggaagtatacatagtcgc

SEQ ID NO: 9292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggcgttctgttattgagtggccatgatca

SEQ ID NO: 9293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggctgctttgcgggggtagaggctagccc

SEQ ID NO: 9294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggctgcttttgttattaagaatcgcttgc

SEQ ID NO: 9295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggaataggtgacgtggcgtggggcgaca

SEQ ID NO: 9296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggacgaagcgtctgacaagttgtccatt

SEQ ID NO: 9297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggagggaccggtgggtgtcatcggtacg

SEQ ID NO: 9298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggcaaccgtgactcaggctctgatgtat

SEQ ID NO: 9299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggcccattgactggaaggtagcccccgg

SEQ ID NO: 9300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggccggtagtgcctgcataactgagacg

SEQ ID NO: 9301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggcgcctggcatttcaccacagcagtat

SEQ ID NO: 9302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggcgcgttctcccccttgatttctgtgt

SEQ ID NO: 9303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggcgcttcctcgatactcctgtgtgccg

SEQ ID NO: 9304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggcggcactgcgcggatccaggcgggca

SEQ ID NO: 9305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggcggtcgggcaatcgctgagtcggtgg

SEQ ID NO: 9306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggggaatacatctgtgaggggctgctgcc

SEQ ID NO: 9307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggggcgatccgaccggcctgtatgttgac

SEQ ID NO: 9308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggggctcagaacgggtggttcgaactgca

SEQ ID NO: 9309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggggagtgattggctgcgaccatggcac

SEQ ID NO: 9310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggggtccccggtcagcgcaagctactcgt

SEQ ID NO: 9311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggggtgtctcggccaactatctgcaaggg

SEQ ID NO: 9312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggtaaaaggtgaatcaatctgagttaac

SEQ ID NO: 9313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggtactttttcgcaatacaggagacact

SEQ ID NO: 9314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggtctggcgtgggtaaatcggccctcac

SEQ ID NO: 9315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggtgcgtctgatgtactctcacctcgcc

SEQ ID NO: 9316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgggtgtttcaaaggctgcgcgatatgttt

SEQ ID NO: 9317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtatggaaagttgaggcgttggttaagt

SEQ ID NO: 9318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtcatttaacgtaaaagccgcagcactg

SEQ ID NO: 9319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtcggccccagtggtaggttcaacggcg

SEQ ID NO: 9320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtcgtgacgaatcctggggggttgaggg

SEQ ID NO: 9321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtgcgaaccgaaagctggctgttgcgcg

SEQ ID NO: 9322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtgggggaatcagcgtcccgtgctgttc

SEQ ID NO: 9323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtgggggtctagatttaacgcgaggtgc

SEQ ID NO: 9324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggttactgggtagacatgcagtttccatc

SEQ ID NO: 9325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggttcaacgtgagtgtgaagcaatgtcca

SEQ ID NO: 9326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggttcaggaagacagggcgctgtggtgcc

SEQ ID NO: 9327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggttccgcaggtcgccgttctaaaccgcg

SEQ ID NO: 9328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggttcggtccacgggcgggttacttgcgg

SEQ ID NO: 9329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtggtttctggtcgcgccccatgtgctgggt

SEQ ID NO: 9330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtaatttagtccattattagccttttgga

SEQ ID NO: 9331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtacaccagtcttcggaaagattcagtat

SEQ ID NO: 9332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtacggctgtttgctgttatttagttatc

SEQ ID NO: 9333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtactgttctagattgtaacccagactta

SEQ ID NO: 9334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtagagcctgagtgcacagggatatcggc

SEQ ID NO: 9335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtagggcgattcgcgtgtatcggttagag

SEQ ID NO: 9336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtccactgtaattaattgaccgtattcgg

SEQ ID NO: 9337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtccgcccttatgatagttgtgtttcgtg

SEQ ID NO: 9338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtccttcggagatggtcttactttctgac

SEQ ID NO: 9339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtccttggctaagcgtcttatcactcttt

SEQ ID NO: 9340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtcggcccgccctgataatcggtacccgc

SEQ ID NO: 9341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtcggtacctagcggttgtttcacagtat

SEQ ID NO: 9342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgaccgaagacacgctgcttccctttat

SEQ ID NO: 9343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgactcggtgtagatccccgccaacttg

SEQ ID NO: 9344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgagccggagtaatcaacgccctgctcg

SEQ ID NO: 9345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgcaaattgcctggtgggtggaccagtc

SEQ ID NO: 9346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgcacttggtcaaatgggtacctcgcac

SEQ ID NO: 9347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgcagatgacttgatgacaaccatgacg

SEQ ID NO: 9348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgcgggcgttggtggaaatgcttgcgcg

SEQ ID NO: 9349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgctgcgtacatcaacgcccatatgcgg

SEQ ID NO: 9350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtggaggccctcaatcgctcttggagggg

SEQ ID NO: 9351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtggcggcgtggtggttgtgcaagcttgt

SEQ ID NO: 9352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgtgaggcgatgttaaccaggaatagtg

SEQ ID NO: 9353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgtgggtaaattatatttacgagggatg

SEQ ID NO: 9354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgtggtgtgtggggaacgacaggataga

SEQ ID NO: 9355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtgttgtgggggtccatccctcctcgact

SEQ ID NO: 9356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttagaagcccacctcttgatatttatga

SEQ ID NO: 9357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttagagcaatgcatcgcctcctattttc

SEQ ID NO: 9358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttagatcgcgctggaagcaactgcccct

SEQ ID NO: 9359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttagttgatatgctggtgctcgtaccgc

SEQ ID NO: 9360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttcagaactgtgattagtccgccccggg

SEQ ID NO: 9361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttcgcacgagaagttcggcggctgaagg

SEQ ID NO: 9362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttctgggttccttgtcggacagtggaaa

SEQ ID NO: 9363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttgtaccagtctagtttaggatttcgat

SEQ ID NO: 9364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtttgaatgatgcaaaaggtaaattttat

SEQ ID NO: 9365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtttggaaaggcacggtatggctgaagtg

SEQ ID NO: 9366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgttttgcagctgatccattacaaggcgtg

SEQ ID NO: 9367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtgtttttgaaaatgtgatcccttccagctt

SEQ ID NO: 9368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttaaacaggcttaacatacggaccttaata

SEQ ID NO: 9369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttaacagcaaccggtggtcttagtacacgc

SEQ ID NO: 9370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttacagacgcccctttatactcttctccct

SEQ ID NO: 9371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttacggaatctagatttggagaatttgagc

SEQ ID NO: 9372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttacggtcgatccaacctgtcaggcaagta

SEQ ID NO: 9373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttacttcgcagccagtttaggattcggacc

SEQ ID NO: 9374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttagaaatccgacccgaaagcaccaggagt

SEQ ID NO: 9375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttagaagaattaagttgtatagccctcctt

SEQ ID NO: 9376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttagacattcaagtaatgtggatcggtgga

SEQ ID NO: 9377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttaggatatcgacccgtatctttgctgggg

SEQ ID NO: 9378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttagggatattccggtccgagctgacatat

SEQ ID NO: 9379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttagggggcattaccttgaactctgcatcc

SEQ ID NO: 9380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttaggtcttggtagacccgagtctaatcgg

SEQ ID NO: 9381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttaggtgcccttagccgatgtaattgtgcg

SEQ ID NO: 9382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttaggtgggccgtaaacttaaacttcggcg

SEQ ID NO: 9383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttagtccgattatgggcgattacgtagtcc

SEQ ID NO: 9384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttatctgttaaaacgttcccggtcggacgg

SEQ ID NO: 9385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttatggccgatttgctctcttggcacaaat

SEQ ID NO: 9386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttatttttaaccgggtctcaatgaataagg

SEQ ID NO: 9387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcacactggttattgtgaagtaaggcggg

SEQ ID NO: 9388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcaccacgtctgtgtactggcacccggac

SEQ ID NO: 9389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcacttgtataacatacgacagcgtgtag

SEQ ID NO: 9390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcagaccgatttgggaatgtggttatcgt

SEQ ID NO: 9391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcagagttgtgcacaggagtcgcgtggtg

SEQ ID NO: 9392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcaggcggagcttccaagtggactttggg

SEQ ID NO: 9393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcagttttcagtatagacggtaggggatt

SEQ ID NO: 9394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcatgagtcatactttagctaaagctctt

SEQ ID NO: 9395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcattttatcgtgtttatattattgtgaa

SEQ ID NO: 9396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcccgttgtctgggcggcgccatatgtcg

SEQ ID NO: 9397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcccttagctagttgtacccctccgttta

SEQ ID NO: 9398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttccgagtctgtcttggtaaactgctgcgc

SEQ ID NO: 9399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttccggcaggaatgaggccccaggtttacg

SEQ ID NO: 9400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttccgtccttcgtctttcacatcctgcaga

SEQ ID NO: 9401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcgaaaccatacgaaaatttagtgtgtca

SEQ ID NO: 9402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcgaagtggaaccggtaaggagtggaaat

SEQ ID NO: 9403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcgcgtgcagttattacgttgcgccctta

SEQ ID NO: 9404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcggagggcacctgtcctgctgtacattg

SEQ ID NO: 9405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcggattccggaatatttgctagtttggg

SEQ ID NO: 9406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcggcgcaagtgggatagcttaatctagg

SEQ ID NO: 9407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcgggatggatcgatgctatacgccgatg

SEQ ID NO: 9408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcgggctttttctcattcagaaccaaatt

SEQ ID NO: 9409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttcggtggttgtcaaggcactaagttggtg

SEQ ID NO: 9410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttctacaccagttgttgctttgatggaccc

SEQ ID NO: 9411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttctagactttggggatcacgtgtgcgggc

SEQ ID NO: 9412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttctccaaggtgctgataattttggcgggc

SEQ ID NO: 9413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttctcctccaaatgttccacgtgtcggcga

SEQ ID NO: 9414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttctgcccggtacgtgacccccgctcggac

SEQ ID NO: 9415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgaacagtctggccggtgtgtcagtgtat

SEQ ID NO: 9416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgaatgtgatgcgggcaggatctggctca

SEQ ID NO: 9417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgacatcttacgagcatttcagagggtga

SEQ ID NO: 9418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgacccgacggagcgctcgccgtactctg

SEQ ID NO: 9419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgacggcgttaagcaaccaagcagtggcc

SEQ ID NO: 9420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgaggcttctagtttgtagaatggttccc

SEQ ID NO: 9421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgaggcttttgatagagagtggagggcaa

SEQ ID NO: 9422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgagtagctcgatattttgcccaatagca

SEQ ID NO: 9423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgatacgtccgatcagggatgggctcaat

SEQ ID NO: 9424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgatattatgatcttctcttatcttcgtg

SEQ ID NO: 9425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgatgagacagtggccaaacgttccgtgg

SEQ ID NO: 9426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgcacacgtatactagttaggccaggagg

SEQ ID NO: 9427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgccacggtggttggtttcttgtttctgc

SEQ ID NO: 9428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgccagaggtgtggctcatccagtccctg

SEQ ID NO: 9429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgccagataatctaccactacggcacaac

SEQ ID NO: 9430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgcccagactgcttctatgctaatagtgc

SEQ ID NO: 9431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgccgcagaacttgcatctatgttttttg

SEQ ID NO: 9432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgcgagttgtagatgacaccaatgagaag

SEQ ID NO: 9433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgcggccacccttgtggtccttgatccaa

SEQ ID NO: 9434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgcgtattcgggtgcaacctgaggggatt

SEQ ID NO: 9435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgctccggtttgctgggcctcaacccagt

SEQ ID NO: 9436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgctctcacgcccgatgagtatcgatctc

SEQ ID NO: 9437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgctggcttttgcgtgcaagcgatccgct

SEQ ID NO: 9438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttggagagcggggatctacgctacagccaa

SEQ ID NO: 9439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttggagaggcacattacatgcatcatcgtc

SEQ ID NO: 9440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttggctcaattctcgtgatcgccccatttc

SEQ ID NO: 9441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgggaagacggaggagctttggcgggccg

SEQ ID NO: 9442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgggcgtccggcattcccacgcgcgggga

SEQ ID NO: 9443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgggtgttcagcgtacatgtggtcactca

SEQ ID NO: 9444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttggtagcaatcacggaacagttcattaac

SEQ ID NO: 9445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgtcatgtggttccgcgggaggtatattc

SEQ ID NO: 9446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgtgcagggactgcaggtttcgtacgacg

SEQ ID NO: 9447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgtgtgcaactcggtaggtatcacggcaa

SEQ ID NO: 9448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgttcggccgttcatcgtcagagggcatt

SEQ ID NO: 9449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgttgcgaagaggtggcctaagggaccga

SEQ ID NO: 9450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttgtttctatcgacttgacgcagtcgtctg

SEQ ID NO: 9451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttacacacttccaatatccggcgctcaat

SEQ ID NO: 9452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttacgacggcaacggtgggacaagctagc

SEQ ID NO: 9453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttagcacgttcttcgcggaaaggatttcc

SEQ ID NO: 9454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttatcctcgcgagccgaaggccactcctg

SEQ ID NO: 9455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttatctagtaggaggaagatatcaatcga

SEQ ID NO: 9456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttatgagcagttcttgccggttctggagc

SEQ ID NO: 9457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttatgtaagtgcattcgtgagatgtatgc

SEQ ID NO: 9458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttcatgggtgttactgggctgcatccttg

SEQ ID NO: 9459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttccgttgggcgcgttctaagacaccagc

SEQ ID NO: 9460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttcctcatcgttaaagagtgagtggcatc

SEQ ID NO: 9461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttgaatccagtgtagttgctggccggccc

SEQ ID NO: 9462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttgagagccttgcgcattctgagtacatc

SEQ ID NO: 9463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttgcaggcgagtattcactggtaggcttt

SEQ ID NO: 9464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttggaataactagtcggccggggaacgaa

SEQ ID NO: 9465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttggagacgggtagatctgtctggagata

SEQ ID NO: 9466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttgggacaccgggcgatgctacggcgcgc

SEQ ID NO: 9467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttgggatgcctttgttacctctatccggg

SEQ ID NO: 9468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttgggctcaaaacaaaggtacatatcgat

SEQ ID NO: 9469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttttagcgtagtggccctggaatcacgctc

SEQ ID NO: 9470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttttccgccaccttacagtttgtctacggc

SEQ ID NO: 9471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttttgagatacgatctcccgatatcgctca

SEQ ID NO: 9472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttttgatgctctaactgaggggtaaaggtc

SEQ ID NO: 9473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agttttgcgaggacaaagaatctcaactcctc

SEQ ID NO: 9474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
agtttttcccactgaaaggcttgcaacccgag

SEQ ID NO: 9475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaaaggctactggctggtcaagtggggtac

SEQ ID NO: 9476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaaagtggcatcccaacggtgagaagtggt

SEQ ID NO: 9477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaaatggataggcttgattgtccctgttcg

SEQ ID NO: 9478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaacaacgacggaagctaacctaaggcgca

SEQ ID NO: 9479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaacccgctaccttcatatcgtccgcgatg

SEQ ID NO: 9480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaaccgaacggcagttttattcgctcgagt

SEQ ID NO: 9481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaacgcgtgatttctttcaggagttctgtg

SEQ ID NO: 9482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaacttggtctacgccatttaccagcctcg

SEQ ID NO: 9483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaagcaggtcccaagcaatcccaatttgtc

SEQ ID NO: 9484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaaggcgagttttggtcatgggaagtatcc

SEQ ID NO: 9485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaagtttccgattcaccttatgtctgtttt

SEQ ID NO: 9486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaatacaatcattgaagtgcgctaatttta

SEQ ID NO: 9487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaatacactcatcggatgggtaagggagca

SEQ ID NO: 9488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaatattgatcgataacgtattcccaactc

SEQ ID NO: 9489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaatcacagctaaagcccaaggatcaacca

SEQ ID NO: 9490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaatcacgacgatagttctctcgtggtgct

SEQ ID NO: 9491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaatccgttacgccttcagctcggtgtatg

SEQ ID NO: 9492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaatgcagagggagcaggtctctggagtcg

SEQ ID NO: 9493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacaatagcctcactcgcttccgtgacgtc

SEQ ID NO: 9494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacaatttggcgcgttaaaaaacgcatgcc

SEQ ID NO: 9495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacacggagtggtaagtgagtgcacgggac

SEQ ID NO: 9496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacactaagacaaaaaactcagtagtgccg

SEQ ID NO: 9497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacaggttcataactggtcgctcggggcct

SEQ ID NO: 9498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacagtcgttaggcggttatagtctcttct

SEQ ID NO: 9499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacagtgcctccagtgtcttagtgtcgagt

SEQ ID NO: 9500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacatacgtgtactgaatgtccgaaattgt

SEQ ID NO: 9501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacatgtacggatcgctttattcagtttcg

SEQ ID NO: 9502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccaaacatcccgaactcttgccagttca

SEQ ID NO: 9503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccaccgaagttgtgaagtcaactagtcg

SEQ ID NO: 9504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccactacgaaacatcgcccgtcatgtgc

SEQ ID NO: 9505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccagttgttcctgggtcacaagttgaac

SEQ ID NO: 9506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccgcagcgctcatgacttatttgggctt

SEQ ID NO: 9507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccggaacgtgcgtgacaaggtcgtagcg

SEQ ID NO: 9508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccggcaacagtttattacacaaaccagg

SEQ ID NO: 9509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccgtgtatgacccatcaacttggcagtc

SEQ ID NO: 9510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccgttcaacactcgggactttgccgcgt

SEQ ID NO: 9511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccgttttctttaacctggagaggacgtg

SEQ ID NO: 9512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacctaacaaattttctaggcttactggtc

SEQ ID NO: 9513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaccttgtccacccataagacgttgggaac

SEQ ID NO: 9514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgattggtgtgtaaggcacgtttcccgg

SEQ ID NO: 9515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgcagtcagaaccctaatcgcgaggtgg

SEQ ID NO: 9516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgcgtaccagtgagaattaccaccgtag

SEQ ID NO: 9517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacggagcttatcatcgaatacccacatga

SEQ ID NO: 9518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgggagagtagacggggacgcacgaagg

SEQ ID NO: 9519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacggtccgtaccaacgtcaaagcgtggaa

SEQ ID NO: 9520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgtccatgttgcgtaccaacgtctctgg

SEQ ID NO: 9521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgtctctcggcatctcccgctacgttcg

SEQ ID NO: 9522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgtgggcttttggttgcaatcttgtctc

SEQ ID NO: 9523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgtgggtgaaaggtgtactgcagctgta

SEQ ID NO: 9524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacgttatgtagagatcattcgcggaaagg

SEQ ID NO: 9525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataactaggttaagactgaactgaaggctagg

SEQ ID NO: 9526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataactcatctctcgttgatcgtccaaggaat

SEQ ID NO: 9527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataactcggtgccatcggagaacgggttttat

SEQ ID NO: 9528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataactgtgcgacgaaggaggtaatgccgctt

SEQ ID NO: 9529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataacttcaaaggtaggtggacttgctcccct

SEQ ID NO: 9530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagaagattatttgacttagggatcagtac

SEQ ID NO: 9531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagacgctttcggcgctggacacattagca

SEQ ID NO: 9532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagactccgttatcctttatttgagcttcg

SEQ ID NO: 9533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagagacaggacctattgcttaagggtctc

SEQ ID NO: 9534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagatagtaacttactcatacggaatgaac

SEQ ID NO: 9535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcaattgtgtcggcaacatgggcagtcc

SEQ ID NO: 9536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcagatattttgatcgtatgaaagtaat

SEQ ID NO: 9537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcagcagtttgttgaacgcctcccgatt

SEQ ID NO: 9538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcctcggtgacatcggcttaatgtggtt

SEQ ID NO: 9539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcgcagccttgggaacacgccggttctt

SEQ ID NO: 9540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcggttatcgttcattggaatgactttc

SEQ ID NO: 9541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagctcgggatcgcctttacatcagcgctc

SEQ ID NO: 9542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcttaatccccgtagcaccttcccgtcg

SEQ ID NO: 9543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagcttgcggtagctgtcgaataggtctgt

SEQ ID NO: 9544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaggagtgccaaaggaggtgagtgccgggc

SEQ ID NO: 9545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaggcaggcgtcggcagggtaggcggcgag

SEQ ID NO: 9546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaggctccgctaacctttgaatgtactgtg

SEQ ID NO: 9547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagggtgagaatgatgtaacggcgtcgagg

SEQ ID NO: 9548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaggtaaaccccaaattaacagaagtattg

SEQ ID NO: 9549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaggtctatagtcatatgtaaagcgtttct

SEQ ID NO: 9550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaggtgataacgcgatgagttcgtggggtg

SEQ ID NO: 9551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataaggtgtgttaggagccgtaacaatcggtg

SEQ ID NO: 9552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagtacatatcgtaagtgcccttatttggg

SEQ ID NO: 9553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagtatgcggttcgtcctcaccaataaggg

SEQ ID NO: 9554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagtcatggtagtgcggtttctggatacgt

SEQ ID NO: 9555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagtcgtggtttgggggagggggttgactc

SEQ ID NO: 9556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagtctgcgattgatatgactgtatatggt

SEQ ID NO: 9557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagtgacggcttcgtctaattgccccaaca

SEQ ID NO: 9558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagtgccgatttaaggtttgtctgcttcgt

SEQ ID NO: 9559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagttatcattcatggtttctacagcccgg

SEQ ID NO: 9560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataagttgcgctacgcgtagtcaatccgtcgg

SEQ ID NO: 9561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataataaagcggagttggattctccgtgcttg

SEQ ID NO: 9562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataataattaccttcgttacttattgtgcgga

SEQ ID NO: 9563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataataccgccgcccttatttgatatgcgtgg

SEQ ID NO: 9564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataataccgtttgtaggagattggggccaggg

SEQ ID NO: 9565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatacgcggacttctcgcgcatggcgagtc

SEQ ID NO: 9566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatataccgaaagcccggggggtgagtcat

SEQ ID NO: 9567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatatcgagattcttaaggttttttgtgac

SEQ ID NO: 9568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcagccgtcccaagcggtgatattgagt

SEQ ID NO: 9569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcagtttacagtcaatatcagtgttagt

SEQ ID NO: 9570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcatggagcgttgaccttctctgctgat

SEQ ID NO: 9571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatccacgcgcggggatgtcatttctcaac

SEQ ID NO: 9572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcccggtgacagataagccgcgctggca

SEQ ID NO: 9573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatccttgtcacggtatgcgattaaaggtg

SEQ ID NO: 9574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcggaatgttatagtaaactactacgct

SEQ ID NO: 9575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcgggcgaggattttgacgtttgcctcg

SEQ ID NO: 9576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcggttggcacgacgttgcatgttgcgc

SEQ ID NO: 9577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatctctgtgttcatcatacacgcacttcg

SEQ ID NO: 9578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatcttgaatctatccgcgatgggcgttgc

SEQ ID NO: 9579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatgcacacaaattgctcgacctggtacgt

SEQ ID NO: 9580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatgcgacccaggctagtactgtttacggc

SEQ ID NO: 9581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatgcttagtccacttggttcccctcatga

SEQ ID NO: 9582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatggccgaggtttgcttgttagagcgcat

SEQ ID NO: 9583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatgtcgtctttctgcgattgttgattgac

SEQ ID NO: 9584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatgtggggggcgaataccaaggactgcct

SEQ ID NO: 9585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatgttctcataagtatacctccagggttg

SEQ ID NO: 9586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataattaagttggaagttgacatgcggactgg

SEQ ID NO: 9587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataattagagttatggcggcgtttcccgcagc

SEQ ID NO: 9588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataattagttaataacacaatttaccgctcga

SEQ ID NO: 9589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataattcttttcccctgtaggctgagccagaa

SEQ ID NO: 9590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataattgcggtcggctgcaggatcaggcccgc

SEQ ID NO: 9591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataattgcgtcgggtgtacctcagctaggtcc

SEQ ID NO: 9592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataattggtaacacgcgaacagcctaccccta

SEQ ID NO: 9593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataatttcaggagtaggcagatccaatttctc

SEQ ID NO: 9594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacaaagcgatgttagcttgttggggcataa

SEQ ID NO: 9595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacaacagccttgacgaggatggtaccaatt

SEQ ID NO: 9596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacaactaggacgtatataagttcctagact

SEQ ID NO: 9597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacaagcgcaagtcagggtaggtagacgcca

SEQ ID NO: 9598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacacaatggggttcgccttcctcgggttat

SEQ ID NO: 9599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacacaggcttttgttgctacattaaaaggg

SEQ ID NO: 9600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacacataggaaacgccactcgctggaagct

SEQ ID NO: 9601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacacggccgctagctttgcgcggtggactc

SEQ ID NO: 9602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacactcaagcaggacaccggtgcaccagcg

SEQ ID NO: 9603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacactcagggatgtaatttagcctgcgttt

SEQ ID NO: 9604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacactgttcacccgcagttatggaggcact

SEQ ID NO: 9605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacacttccctgtattgcgtaatcatattgt

SEQ ID NO: 9606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacacttccgatgattgtcccttctgagtgc

SEQ ID NO: 9607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacagagattgtcgtaatgagagcagtgatt

SEQ ID NO: 9608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacagatctatagcagagcctaatacctgtt

SEQ ID NO: 9609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacagcatcggtgcagtcctagcgatgtgcg

SEQ ID NO: 9610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacagctcggtttaggtggccgcaaacgatg

SEQ ID NO: 9611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacaggagagcacgacgttcggagcggcctc

SEQ ID NO: 9612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacaggctgacaatagtgtctgagtccacgc

SEQ ID NO: 9613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacaggttagtgcagtcatcaggagagtgcg

SEQ ID NO: 9614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacagtataaagccgctatctacggggctcg

SEQ ID NO: 9615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacagtgaggggcactaggccacgcatcgga

SEQ ID NO: 9616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacatacctatctcaacgtccagacatgtga

SEQ ID NO: 9617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacatattcggcatagcatccattgatactg

SEQ ID NO: 9618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacatcacaggagagtgattaggcttcgttg

SEQ ID NO: 9619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacatccgactcaccgctctcgatttcttcg

SEQ ID NO: 9620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacatcgcggtcgaaagtgcgcataggcgaa

SEQ ID NO: 9621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacatgtgtgtgttgtttaaaagttgacctc

SEQ ID NO: 9622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacattctagtggccggaattaagcagaacg

SEQ ID NO: 9623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacattgcgcgccctagttcccgctatgacc

SEQ ID NO: 9624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacattgtcatcttacttgtcagatcaggcc

SEQ ID NO: 9625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaaaaagcagcgacgttctggcaaatta

SEQ ID NO: 9626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaaagacggtcttccggattcgtgtgtg

SEQ ID NO: 9627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaaccattcagctgccggctggagttca

SEQ ID NO: 9628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaacttccttgccaccctgacgatgctg

SEQ ID NO: 9629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaagacgagatacattcttcacacgttg

SEQ ID NO: 9630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaagcacctccccggtagcgatgtatgc

SEQ ID NO: 9631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaagcgggtgctcgcagaggtattcggc

SEQ ID NO: 9632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaagggcgtttctcagatccagggtgct

SEQ ID NO: 9633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccaatactgcgttcacccagcgatgattg

SEQ ID NO: 9634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccacttttctttgcaaagtcgttgggaca

SEQ ID NO: 9635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccatcgaagtgattctccacctgcgacgc

SEQ ID NO: 9636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacccagcctcctaaaaaatttccgcagcat

SEQ ID NO: 9637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacccaggaaaatggaacggattgtacgggg

SEQ ID NO: 9638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacccagtgcatctcgttgcttcctgtccgt

SEQ ID NO: 9639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccccagcaacgcgcagctccatgcgatct

SEQ ID NO: 9640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacccctactcaaaatgggttggaacagttt

SEQ ID NO: 9641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacccgcctagttcaggagatttctccccgc

SEQ ID NO: 9642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccctgcgatacaggggaacgtcgctggct

SEQ ID NO: 9643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacccttcatccagaccgttgaccttctcca

SEQ ID NO: 9644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccctttgtacgctgcagctcatatcggac

SEQ ID NO: 9645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgagagttggtgctgggttataacggtt

SEQ ID NO: 9646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgagctccgggaaggcttttgcggagtg

SEQ ID NO: 9647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgagtacctgttctgtgctttgcatctg

SEQ ID NO: 9648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgcagtggtgtttatcccccagtatttc

SEQ ID NO: 9649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgccggaggtatcaaccggtaacgtacc

SEQ ID NO: 9650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgcggaagcgaagggggctttcgtgcga

SEQ ID NO: 9651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgcggtatgcgtcataggctgccagctt

SEQ ID NO: 9652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccggaggcttcttatagttttcggtgttt

SEQ ID NO: 9653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccggcgccaccctcgatattttgtgtaca

SEQ ID NO: 9654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgggagaattccgccgggttctgggatc

SEQ ID NO: 9655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccggtcttctagtgtcatactacgctagg

SEQ ID NO: 9656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgtacagcagccacagtgaccaaaggcg

SEQ ID NO: 9657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccgtggcattcactatactccatgttaag

SEQ ID NO: 9658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacctagcaaaacaggcttccgcacgctagc

SEQ ID NO: 9659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacctgattcgttgcgtttcgtcgtaatgtg

SEQ ID NO: 9660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacctgattctctttaagcttcgttacacca

SEQ ID NO: 9661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacctgccacccgtaatccccatgatggcgt

SEQ ID NO: 9662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccttatcaatcacttagccgtcgtctgcc

SEQ ID NO: 9663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataccttttaacagggggtgatgccgtccgag

SEQ ID NO: 9664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgaaggagatgcttgactatgcagcgtct

SEQ ID NO: 9665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgaagggtaactggggatttctgtctgcc

SEQ ID NO: 9666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgaatcagcaatccgcaaagagaatactt

SEQ ID NO: 9667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgacatggatgttacgattggcgtggttt

SEQ ID NO: 9668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgacatttggaaacgagtattcttacctc

SEQ ID NO: 9669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgagactgaggctatggcgtctttcctag

SEQ ID NO: 9670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgagtgctgcaccaggccggctccttacg

SEQ ID NO: 9671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgatatcgagctcgggccaagcactactg

SEQ ID NO: 9672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgatcggacggatgagtgaactgtacctt

SEQ ID NO: 9673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcaactggcccctcttggtgagtgatgg

SEQ ID NO: 9674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcaatcgagaggagtagtactctgcgtc

SEQ ID NO: 9675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcaattcgggcacagacggttcctgtgg

SEQ ID NO: 9676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcacaaaggatagcggagacaactcgcg

SEQ ID NO: 9677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcacccaggacgcccattctctgcggaa

SEQ ID NO: 9678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcattccatagtccgagtatccctgact

SEQ ID NO: 9679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgccagcccacttcctcgtacctcagtgt

SEQ ID NO: 9680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgccaggtagctgagcgagtatctccggg

SEQ ID NO: 9681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgccatctttcttttacggttgtagggtt

SEQ ID NO: 9682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgccatttcacgttgatatatgtgatggt

SEQ ID NO: 9683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgccccgctcggttggagcatctgcacat

SEQ ID NO: 9684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcccgctggaacctcgttggggtcgcgt

SEQ ID NO: 9685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcccggtcacctgtttctagagcgatgg

SEQ ID NO: 9686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgccctggggatctgataattcctcatgc

SEQ ID NO: 9687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcgaagtaaaccgctcaccctcttgctc

SEQ ID NO: 9688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcgatgacgtgaagtgggagattccgag

SEQ ID NO: 9689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgctaacgcctgttccggtgctccctagg

SEQ ID NO: 9690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgcttgatgtgcctgctattgtttctcgt

SEQ ID NO: 9691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggactcgaacgcatgccggcataagtgt

SEQ ID NO: 9692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggcataatcattccgatttcaactatgt

SEQ ID NO: 9693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggcccctaggcgacgctatggcattccc

SEQ ID NO: 9694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggctgtgtgcgtagctctgcttggtgag

SEQ ID NO: 9695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgggaattcatgtggtgttcgaagctctg

SEQ ID NO: 9696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgggctagaggaatccgtcatcacgttac

SEQ ID NO: 9697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgggggttcccaagcgtggacacagcctt

SEQ ID NO: 9698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggggttttgttctcgttcgaccgatgtg

SEQ ID NO: 9699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggtagcggtcacgactcgacaactgatc

SEQ ID NO: 9700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggtcggggttgagtctcgtaagatcgga

SEQ ID NO: 9701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggtgtaccttattaacaaccatttcaat

SEQ ID NO: 9702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacggttgctgaccccagcctttcctcgccg

SEQ ID NO: 9703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgtacgtggacggtcaggcgtgccgggga

SEQ ID NO: 9704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgtagtaagtggccgtccaccaatatttt

SEQ ID NO: 9705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgtagttgtcgtgttatctcgatttcaaa

SEQ ID NO: 9706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgtgcattgctttctcgtcattcttgttc

SEQ ID NO: 9707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgtgcgaatgtctcgtcaatgttttcgcg

SEQ ID NO: 9708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgtggagcatctggcgattgagctcgagc

SEQ ID NO: 9709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgtggcactggacaaaaaataacagtact

SEQ ID NO: 9710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgttatcgtaatagtaatatgcttgttgt

SEQ ID NO: 9711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacgttttcgattgtaggagaagacccgtat

SEQ ID NO: 9712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactaaaggcgtgctgggggagggtcatacg

SEQ ID NO: 9713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactaagctattacgccacgcagaattctca

SEQ ID NO: 9714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactactcatttgagtctgtcagaagtattc

SEQ ID NO: 9715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactagaagatgacaccttgatcagccactg

SEQ ID NO: 9716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactatctgtggagtaattccctcgctcggt

SEQ ID NO: 9717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcaatggttgtgttacctactgatcggg

SEQ ID NO: 9718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcacacttccgagaggcaaaaccgaatc

SEQ ID NO: 9719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcacgtggtgttataaatgtccgcgagt

SEQ ID NO: 9720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcagagcaggtcgtcgttcgatgcgccg

SEQ ID NO: 9721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcaggatccggagctacgttggatcgtc

SEQ ID NO: 9722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcagtgcaatgcagtattaatctcactc

SEQ ID NO: 9723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcatgacaccgcagatgtattggcgtgt

SEQ ID NO: 9724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcatttctttttccatcactgttatcgt

SEQ ID NO: 9725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcccaatgccgtatctggtcgtgttcgg

SEQ ID NO: 9726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcccggacaacaatataatccacgttac

SEQ ID NO: 9727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactccgaggaggcgacctgtcgatgtgccg

SEQ ID NO: 9728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactccgtcgcctagcttgcgaaatttggcg

SEQ ID NO: 9729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcgtaacaggcggttagatgtacgccac

SEQ ID NO: 9730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactcgttaccaagatctatgtcgtcgcgag

SEQ ID NO: 9731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactctcactagtagtgcgactaaaactgtc

SEQ ID NO: 9732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgaacgtgacgtccacagataccacgtc

SEQ ID NO: 9733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgactccggttccgtgtaccttcagcat

SEQ ID NO: 9734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgctcgttagccatatgctagtgccacg

SEQ ID NO: 9735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgctgccccagctcggcgggatcgcagg

SEQ ID NO: 9736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactggaatccacatggtgatctgcaggagt

SEQ ID NO: 9737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactggaggacattgattaccaattgacgat

SEQ ID NO: 9738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactggcgacaatttgggcgttcacactctg

SEQ ID NO: 9739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactggggaaatatcgccgacttttctaagc

SEQ ID NO: 9740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactggggaattcaccataacatggggcagc

SEQ ID NO: 9741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactggggttgttaacgtataagtcccatac

SEQ ID NO: 9742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgtatctgaaatagagtgggacgcctgt

SEQ ID NO: 9743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgtgcttgagactgattggccccattcc

SEQ ID NO: 9744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgtgggactcggggtgaccaggtgcccg

SEQ ID NO: 9745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactgtgtgttaggcattgaaccaagatact

SEQ ID NO: 9746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttaagggccatcaaagtccgcactagga

SEQ ID NO: 9747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttacgttgctacgcgtcgcgccctttac

SEQ ID NO: 9748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttagacgacccaagtggaatgtattgca

SEQ ID NO: 9749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttcaaattcttatcactgcgatgtagat

SEQ ID NO: 9750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttcaccccacgttactatcaatttgtcc

SEQ ID NO: 9751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttcctggggcgggcggcgattgcagttc

SEQ ID NO: 9752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttgcacatttcggtcacttagcgagggg

SEQ ID NO: 9753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atacttgccattatgtgtattactgtcgctcc

SEQ ID NO: 9754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atactttaccggctcaatagggtcgtgatcct

SEQ ID NO: 9755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagaagcgtgggtagtattacactaatgctg

SEQ ID NO: 9756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagaatgtgtcgcgctgcatgtgcttaacca

SEQ ID NO: 9757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagacaccagatttctctattcaactacgtc

SEQ ID NO: 9758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagacattggtcacgccccccgccgccgcct

SEQ ID NO: 9759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagaccccttctcgaggagttcaatgtttgc

SEQ ID NO: 9760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagacctcaagaagagtatctagctgggcgg

SEQ ID NO: 9761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagacgctagcagccacacagttagggaatt

SEQ ID NO: 9762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagacggctcttaatgttgaggcttgcattg

SEQ ID NO: 9763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagactatgtcgtgaacgctttaccgacacc

SEQ ID NO: 9764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagagaacgcgccagttgcctcatcgctcct

SEQ ID NO: 9765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagagcacttacaatcgaccacacctatatc

SEQ ID NO: 9766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagagccataatgccgcccgttgatctcctg

SEQ ID NO: 9767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagagcgacgggaaaccactcgctttaaaag

SEQ ID NO: 9768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagaggtggatcgtatgacgcccggcttagg

SEQ ID NO: 9769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagagtcaatgtctttcaggacacccttcta

SEQ ID NO: 9770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagagttgccgctgtacactatcacgcattg

SEQ ID NO: 9771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagatcctatttatactttaactgccttctt

SEQ ID NO: 9772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagatcgtgtgtttctctaggttccccggta

SEQ ID NO: 9773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagatctcaatgtggttttattcccgggtga

SEQ ID NO: 9774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagatgcaccgcgatgtgaatgtgtgacggt

SEQ ID NO: 9775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagatgcgcttgtacggtaaggacggtcttg

SEQ ID NO: 9776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagattggatttgaagaaccccacaccacca

SEQ ID NO: 9777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcaaaggcggtgcctgtctgagtaagacg

SEQ ID NO: 9778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcaacatgtgggatgacgccaagggcggt

SEQ ID NO: 9779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcacagaagaggtcacgatcccaccgcca

SEQ ID NO: 9780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcacgtttcttagcgttggcgccgtgact

SEQ ID NO: 9781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcactcgattgtagtggtggcaatggatg

SEQ ID NO: 9782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcagaatcgggagtaaccgcgggtgttgt

SEQ ID NO: 9783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcagggcggacgttcgctgcagttagacg

SEQ ID NO: 9784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcataacgaaagcgtctttgtacagctcc

SEQ ID NO: 9785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcatagcaggtgggtgtcacttcgcttag

SEQ ID NO: 9786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcatattgcgggccagggagcatatgttg

SEQ ID NO: 9787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcatcaggccgggcaacagtagatcccgg

SEQ ID NO: 9788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcatcctacggggttctaagtcggggaca

SEQ ID NO: 9789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcatgtcagaaaattgaaagtgagtgtca

SEQ ID NO: 9790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcattcctcgctcatggcaaacgacagcc

SEQ ID NO: 9791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagccaatgtgcgtatctgaggtccccggcc

SEQ ID NO: 9792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagccactttgcgtcattcttggtttttgac

SEQ ID NO: 9793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagccaggcaagttggaatatagatgcacgg

SEQ ID NO: 9794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagccatcggcgcagtaactgatggtgcgtt

SEQ ID NO: 9795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcccccacagcgtaggtgtgcgacttagt

SEQ ID NO: 9796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcccctttcctcaagccgcccataatttc

SEQ ID NO: 9797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagccgccgtcgaagggcaaaacttcagggt

SEQ ID NO: 9798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagccgctgagttgtgctactggtgcctgat

SEQ ID NO: 9799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcctcagccagatgtgggctgaggttgat

SEQ ID NO: 9800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcctcccattaggtcgctctgcttttact

SEQ ID NO: 9801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcctggccgaggtattttcatggggcggt

SEQ ID NO: 9802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcgaaacgtctaaagacttctcatgacaa

SEQ ID NO: 9803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcgatcggtggaaaattcgcggcccaaat

SEQ ID NO: 9804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcgcaggtgctcgttggctttacaggcac

SEQ ID NO: 9805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcgcgatcaaatcataggggtaggctgtt

SEQ ID NO: 9806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcgcgtggagaaggggcgtgttgcaatcc

SEQ ID NO: 9807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcggtgatttcgtaataagttctaaccta

SEQ ID NO: 9808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcgtaacttttagtccctgctcaattatt

SEQ ID NO: 9809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctagcggttgatgtatgctcatgcctgc

SEQ ID NO: 9810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctatcgtcatcacccgttttacgaccgc

SEQ ID NO: 9811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctatgcgaggcaatgggtatgcgagttt

SEQ ID NO: 9812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctctagatccccgccgtcaatgcaaatc

SEQ ID NO: 9813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctctatggtgtagaataagtcactcggg

SEQ ID NO: 9814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctctctgcgtacttcggggacacacttc

SEQ ID NO: 9815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctctggattaactctgccggattgacgg

SEQ ID NO: 9816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctggcacgttcttggtcgcgagacatgg

SEQ ID NO: 9817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagctgtatcgtcattaggtggttttatccg

SEQ ID NO: 9818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcttgtcgctgagatacgagacgtccctg

SEQ ID NO: 9819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagcttgtgggtatatgtgcgagctcaggtt

SEQ ID NO: 9820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggaaatgcccagcgggacgaggcagtcca

SEQ ID NO: 9821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggaagtggcggttcgagatttattcccac

SEQ ID NO: 9822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggaattcctgtctcggatagcctcttggg

SEQ ID NO: 9823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggacccagtttttcggatctgacgtggca

SEQ ID NO: 9824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggaccgtaggaatctaggagcttcgtagc

SEQ ID NO: 9825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggagcgccagcaactggtgaggataaatg

SEQ ID NO: 9826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggaggctgtcatgcccgtctcataagtat

SEQ ID NO: 9827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggatatgtagacctaggatacgcaagtca

SEQ ID NO: 9828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggatggttttgcggtctccagccccactg

SEQ ID NO: 9829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggcaacacggtgctgctcgttgttgcgtt

SEQ ID NO: 9830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggcaatttgtagcattccttatattttcg

SEQ ID NO: 9831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggcagtaacgggttgtgttcgcaacgtgg

SEQ ID NO: 9832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggccccaagtcaacacgggttaacgagtg

SEQ ID NO: 9833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggcccgcgagtgtcgtgatgatgaagcta

SEQ ID NO: 9834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggccgcttaacttcccgtaacaatgggtg

SEQ ID NO: 9835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggccttgatgcagctcacacgagtgggtt

SEQ ID NO: 9836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggcgatcggtgcggacagggggccagtag

SEQ ID NO: 9837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggctacaattgagtatggtgttacaacct

SEQ ID NO: 9838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggctggagctagtgcacacaaacgtgaca

SEQ ID NO: 9839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggctgtggcaagtacattataggcacgtt

SEQ ID NO: 9840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggaagctagcctgaatgggacccggtgt

SEQ ID NO: 9841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggcgaatcgggttaaggttgatttgatg

SEQ ID NO: 9842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggcggcaatcacagaagcactgtacttt

SEQ ID NO: 9843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggctatcttgaggaacgatactcgcggt

SEQ ID NO: 9844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggggccgtgtccgctgtctgtgatatggc

SEQ ID NO: 9845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggggcgcggggaacagtacgtcttagctc

SEQ ID NO: 9846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggggcggagtagggtaggtagctatggac

SEQ ID NO: 9847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggtactagtgctcgtcgttgtggcaagc

SEQ ID NO: 9848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggtatgcagaaggctgatgtaatcgagg

SEQ ID NO: 9849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggtgcagcgggtcggagtcacgtttaat

SEQ ID NO: 9850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagggttgatttaatggcttttgttttcagc

SEQ ID NO: 9851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggtgagggtggcccgtaaacaccgttcac

SEQ ID NO: 9852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggtgataacaactagccatggtggtatcg

SEQ ID NO: 9853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggtgatcttcttttatggcgcaggtatcc

SEQ ID NO: 9854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggtggtcctctctcagaaatccatcaaga

SEQ ID NO: 9855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggtgttcatgcggatggtcgaccttaagc

SEQ ID NO: 9856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ataggtttcgaatgttgttctagttgaatgcg

SEQ ID NO: 9857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtaactcggtgcggcggcagtgtctatac

SEQ ID NO: 9858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtactaaggggtttgtttctcgggcatcg

SEQ ID NO: 9859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtagctatggctagtcttccgctcgccgc

SEQ ID NO: 9860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtaggcaggctaaccggcattatatccgc

SEQ ID NO: 9861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtagtgggcaaccggcatattctaccagg

SEQ ID NO: 9862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtatcagttggtatctattttctcgcgag

SEQ ID NO: 9863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtatcgtctgaactgcagtgtgttccggc

SEQ ID NO: 9864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtcagtacttaccgggtttggggttcgat

SEQ ID NO: 9865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtccatgctgtgcaggagtcatcactcgc

SEQ ID NO: 9866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtcccagcatcgtcatacatttgatggag

SEQ ID NO: 9867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtctagaactcgagctgccggaggcttag

SEQ ID NO: 9868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtctcatcttacacgttttcgcagtgggg

SEQ ID NO: 9869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtctcccgcggaagccagctcgattccta

SEQ ID NO: 9870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtctcgatatcgataaggaaccgccggcc

SEQ ID NO: 9871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtctcgtgtgttaagcgtgctgatccgtt

SEQ ID NO: 9872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtctggcggagttatgcctatgatttggg

SEQ ID NO: 9873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgatcgagcgcccacactgtttttactt

SEQ ID NO: 9874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgatcggtgtagcctagaaaaaagaccg

SEQ ID NO: 9875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgcacgagtggtcctaacgtcggatgcg

SEQ ID NO: 9876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgcctaaggtcctacgttggttgatgtg

SEQ ID NO: 9877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgctcaggcaatgtatggaaatagatac

SEQ ID NO: 9878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgcttgattgcagactgttaccgctatt

SEQ ID NO: 9879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtggcaagatgagcgggggctgaggccgg

SEQ ID NO: 9880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtggcagagcatgggtgggtcacacgggg

SEQ ID NO: 9881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtggctaacttcctggattaaacttgctc

SEQ ID NO: 9882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgtacctcgtgtccctaaagtaaacaag

SEQ ID NO: 9883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtgtgggccatattgattggtatggtggt

SEQ ID NO: 9884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagttgatgcgtgggtctggctgacgcagta

SEQ ID NO: 9885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtttagaatgagaacgtggctggtttgct

SEQ ID NO: 9886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atagtttagctatggtgacacctgcccaacct

SEQ ID NO: 9887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atataaacgacttcctcttgcattgcggtgac

SEQ ID NO: 9888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atataaactacaagacgaggtttgccggtttt

SEQ ID NO: 9889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atataaatgcgttgaacgtttttcaaccttta

SEQ ID NO: 9890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atataatccagcccacccttcttccctcagcc

SEQ ID NO: 9891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatacagcccgtcaactatagtcatctttaa

SEQ ID NO: 9892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atataccgggaagcatcgataactttgctcgg

SEQ ID NO: 9893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatacgcttgtaggcaatcggtaactcttcg

SEQ ID NO: 9894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatagcactcaagaacgcgccgagtagcgtt

SEQ ID NO: 9895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatagccgggcgactataacgttggatagct

SEQ ID NO: 9896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatagctctctgtagcttggtgaggaatgaa

SEQ ID NO: 9897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatagggatgcttgtctgactatctggcgct

SEQ ID NO: 9898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatagtctcttatcctagcaccatcgctgtc

SEQ ID NO: 9899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatagtggccactgttgggctggacgagttg

SEQ ID NO: 9900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatatcgacataatgtgattttaagattgtt

SEQ ID NO: 9901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatatcggtcataaggaatctcatgtaggcc

SEQ ID NO: 9902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcaacaaactgggtgactctgggttgaag

SEQ ID NO: 9903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcaacgtcttttttttccggtggatttcc

SEQ ID NO: 9904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcactgtgcaacgtcgctccgcattgttg

SEQ ID NO: 9905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcatacttgttatgagtctgtaggtgcca

SEQ ID NO: 9906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcatttcgcgtgatgaaaatattagtgcg

SEQ ID NO: 9907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatccaactgttaggatgcttctatttgtcc

SEQ ID NO: 9908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatccacatccgtcgaagcttgcactgttgg

SEQ ID NO: 9909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcccgccccgtctacacatttcatcgttg

SEQ ID NO: 9910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcctcattgattcatttggggctcataga

SEQ ID NO: 9911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcctccgatggtcgtttggcgcttttaaa

SEQ ID NO: 9912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcctctgtctactttccgcgccaattctt

SEQ ID NO: 9913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcctggcacgaagatgaagcgaaggagct

SEQ ID NO: 9914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatccttaacattattatatgcgtcacttgc

SEQ ID NO: 9915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatccttctactggactattttacctgggac

SEQ ID NO: 9916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgatgtaacgaaatgtacgcagaataaa

SEQ ID NO: 9917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgcggcagaagggctaccggggctcacg

SEQ ID NO: 9918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgcgtataggtagcactaatcgggttgt

SEQ ID NO: 9919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgctgcgtcacttaggctctcgtttaga

SEQ ID NO: 9920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcggggtgtctctactttggttatctgtt

SEQ ID NO: 9921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcggtgtgaaagcagtgaccatgtccgtt

SEQ ID NO: 9922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgtaccgtactcgagacaatgataaaga

SEQ ID NO: 9923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgtatttcgcaacgaaactgactttttt

SEQ ID NO: 9924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgtcaaaacgccaagtcggtttgaggcg

SEQ ID NO: 9925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgtgcaaacatgatgtcgtgataccggg

SEQ ID NO: 9926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgtgggaacggtggggtccgcgcttccc

SEQ ID NO: 9927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgtgtgccgacctcgatattgtggtctg

SEQ ID NO: 9928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgtgtggacatgaaacgtagattttctc

SEQ ID NO: 9929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcgttagcccttgctcctcgctgatctaa

SEQ ID NO: 9930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatctcgagcgtacttttacccgctacccgg

SEQ ID NO: 9931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatctctggtgcatggtgtaactttcctgag

SEQ ID NO: 9932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatctgcgtggggcgacgttcttctggtctt

SEQ ID NO: 9933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcttacgtcatctggtagtgcttattgcg

SEQ ID NO: 9934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcttcattcacctaggaacaaataagccg

SEQ ID NO: 9935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatcttggggccgtcttgccaactgcgcatt

SEQ ID NO: 9936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgaatgatgatctggagtggaacgtataa

SEQ ID NO: 9937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgacagcagactcattctatgtggcgcac

SEQ ID NO: 9938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgacttgagccatgtaaacgggcttccac

SEQ ID NO: 9939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgagacaacgatttgacagcagtcgcgcc

SEQ ID NO: 9940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgagtgcagcagacgtgcatcgtcagcaa

SEQ ID NO: 9941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcaaagttgcctcgtatgatttacggtt

SEQ ID NO: 9942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcacattttaaaaaatagccgaaattga

SEQ ID NO: 9943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcactggtaatagccctagcgctcatcg

SEQ ID NO: 9944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcagctcctgactctgtcacggccgccc

SEQ ID NO: 9945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcagtagtaccatgtgttcgtaaccctc

SEQ ID NO: 9946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgccaataatcgtgtgactgttatgttag

SEQ ID NO: 9947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgccacaaattatgaaagtttggtcagag

SEQ ID NO: 9948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgccagttaggaataaccggtgaacctgt

SEQ ID NO: 9949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgccctcgaagcgcttagcctgaggccgc

SEQ ID NO: 9950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgccttacatgcgacccacgctcattcgt

SEQ ID NO: 9951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcgaaacgattcactgctgtcgaggtcg

SEQ ID NO: 9952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcgcggcaagtgagatacgtatcttaag

SEQ ID NO: 9953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcgcgggacacgttctccttggtagggc

SEQ ID NO: 9954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcgcttgctctccgggggtgtcgaacgc

SEQ ID NO: 9955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcggataagagcatgtccgttacgtatc

SEQ ID NO: 9956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcgtcattggaactatcgcgttattcgg

SEQ ID NO: 9957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcgtgctgcttcatgggaggtttatggg

SEQ ID NO: 9958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgctactcggtactcgtaagggtgttaaa

SEQ ID NO: 9959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgctcctcagcgcggtagttccggcacgt

SEQ ID NO: 9960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcttagctcacggttttgcgcagccatg

SEQ ID NO: 9961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgcttagtcacgcgagttagcttcctttt

SEQ ID NO: 9962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgctttaggagtcctgctcaggatggtat

SEQ ID NO: 9963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatggaggtcaactattacggcgggatcaga

SEQ ID NO: 9964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgggcccggcacattatatggcttgcgat

SEQ ID NO: 9965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgggtgcggcagggtccgatacttccttg

SEQ ID NO: 9966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatggtattccgccataacacatacctactc

SEQ ID NO: 9967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatggtctctggacggggatcgggtggggta

SEQ ID NO: 9968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtatagccggtaattcaactgcgagtat

SEQ ID NO: 9969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtgaaagggcggtcgaaactggagaaac

SEQ ID NO: 9970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtgacttttggttagcggggatatttgg

SEQ ID NO: 9971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtgatcttgtctgcagtgcgggcatctt

SEQ ID NO: 9972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtggttcatagtctacggaggctactat

SEQ ID NO: 9973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtgtgagccatgtattcgctgccgccgt

SEQ ID NO: 9974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtgtgtgtctttagtgggtcctcaagct

SEQ ID NO: 9975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgttccaagccagtcgcaacatgtagaac

SEQ ID NO: 9976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatgtttggaaggccgtttctcaaggtcgta

SEQ ID NO: 9977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattaagcggctcccctgcttgcaagcggtt

SEQ ID NO: 9978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattacccggtcgtccatgacacctttcgat

SEQ ID NO: 9979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattatctgcagaccgggcaagatggccagt

SEQ ID NO: 9980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattattgtgcactctgcggcgtgttgaagg

SEQ ID NO: 9981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattatttcgatgctaaactatgtccaggac

SEQ ID NO: 9982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattcacgttggtccttcttctatttgagtg

SEQ ID NO: 9983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattcagcaggccgagaatcggagtagtgtg

SEQ ID NO: 9984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattcccaagagctcgatgcttaaatgttta

SEQ ID NO: 9985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattcctcagcgctccttagaattcccccct

SEQ ID NO: 9986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattcgggcatgcgagcggaaacatcgtgtc

SEQ ID NO: 9987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgaacaaccgtaccgcctgaaacacgag

SEQ ID NO: 9988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgaacatgcgaatacatctaaacgtggc

SEQ ID NO: 9989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgacaaagtgatgaaaatgaggatgcgg

SEQ ID NO: 9990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgcctggctttttcatgaccatgtcggc

SEQ ID NO: 9991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattggtatgtggtttagaggtttcctaggc

SEQ ID NO: 9992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattggtgctccgctcagtcgcgcttctttc

SEQ ID NO: 9993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattggttacaagcgttggtactcgccattt

SEQ ID NO: 9994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgtacctgtagcggtgtttggccgtcct

SEQ ID NO: 9995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgtgctgggaaccctcaggtttctggag

SEQ ID NO: 9996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgtggcagattgttcagtacacttgtac

SEQ ID NO: 9997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattgttgtcgtgaacctcgctcagaatctt

SEQ ID NO: 9998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatttatgtcactattttgctgattctattt

SEQ ID NO: 9999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatttctcactaaattgtgggaatcaaattt

SEQ ID NO: 10000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatttgagcactgtcacttccgaagttgcgc

SEQ ID NO: 10001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatttgagtttgtgctatcgcaatgatgaag

SEQ ID NO: 10002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atatttgcactgtttatgtttcatctcgttac

SEQ ID NO: 10003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattttctatgcgcagtgtattggtcggagg

SEQ ID NO: 10004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atattttgggcccatacgctcttacgctggta

SEQ ID NO: 10005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaacgaaacggttgctaaacacggcgcgc

SEQ ID NO: 10006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaacgctcacttatcttatgatcgtgtgc

SEQ ID NO: 10007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaacgggtttctttacatcactcacggtg

SEQ ID NO: 10008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaactagttagggtctgagaagccgctgg

SEQ ID NO: 10009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaagcgtgtaaccgtactcccatgaatcc

SEQ ID NO: 10010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaaggtgctgctgtgcctccctgttctcc

SEQ ID NO: 10011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaagttgaggggactacttaggcgccatg

SEQ ID NO: 10012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaattatgtcttgtcgggcctagtactgg

SEQ ID NO: 10013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacaagatctctttggtctcacaggttag

SEQ ID NO: 10014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacacgcgagcttactgccggtgcactaa

SEQ ID NO: 10015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacacgttctgactagggcaagggatttg

SEQ ID NO: 10016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacagtctactgccacttctcatcgttag

SEQ ID NO: 10017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacatgcgctttgcatctggggaatgacg

SEQ ID NO: 10018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacatggggcctaaaaacctctttgtcgt

SEQ ID NO: 10019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaccgaactggtatctgttgagcgttgcg

SEQ ID NO: 10020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaaccggagtctgtgcctgaatgaattgtt

SEQ ID NO: 10021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacgatgcatattgctccgtgcgtgcctc

SEQ ID NO: 10022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacgggtcaaactcgtattctgagatttg

SEQ ID NO: 10023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaactactcgccagccagggtacagggtgg

SEQ ID NO: 10024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaactcgcacgataatctgtggaatatgga

SEQ ID NO: 10025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaactgggtaccactcttgggattttgggg

SEQ ID NO: 10026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaacttggcgttcattcccttcgtaaccct

SEQ ID NO: 10027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagaaggctatccattttacccccgtgac

SEQ ID NO: 10028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagacacgagttcgcgatggactcggccc

SEQ ID NO: 10029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagccgtctgggcatacggtccagtttaa

SEQ ID NO: 10030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagcggtactaccacgcccatcggttagc

SEQ ID NO: 10031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagggagagtacggtgcggcagggtgtct

SEQ ID NO: 10032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagtggatcgcaaccgtggcacgccgttg

SEQ ID NO: 10033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagtggggtacgtctatcgaggtgtttcg

SEQ ID NO: 10034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaagtgtaattccccgcgttgctgacgaaa

SEQ ID NO: 10035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaatagcacaccggcccgttacgaaaaaac

SEQ ID NO: 10036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaatagccttcatcctacgatttccgagat

SEQ ID NO: 10037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaatgacacgcgcctcgaattgacggaatg

SEQ ID NO: 10038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaatggggcctattcctgctttagtcttca

SEQ ID NO: 10039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaattcccgaggacctatcggcgactggca

SEQ ID NO: 10040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaattggccggtgacggaacagggacgcca

SEQ ID NO: 10041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacaccaagaggaccacactagccagggtg

SEQ ID NO: 10042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacacggccggttggctgtgcctcctccgg

SEQ ID NO: 10043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacacggtcggaggcgggccggcatttgct

SEQ ID NO: 10044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacacttgcttgacgtcccccgtgcggcgg

SEQ ID NO: 10045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacagaaattctctgagcccgttggaaacg

SEQ ID NO: 10046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacagacgcgaagggagcattgatactgga

SEQ ID NO: 10047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacagaggatttatcggctgccctgcagga

SEQ ID NO: 10048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacaggagttaggctgccatatgcgtcttt

SEQ ID NO: 10049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacaggcaaaaccgaggcttgaacgctttg

SEQ ID NO: 10050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacagtcgtcctcgctatattggtgcgaga

SEQ ID NO: 10051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacatcaactttagcacgagctagtagccc

SEQ ID NO: 10052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacatcttgaagtctcactgtggtaatttg

SEQ ID NO: 10053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacatgtggtggtgggattccctcagcgag

SEQ ID NO: 10054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccatttactcgagtttcacgcacgttat

SEQ ID NO: 10055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacccacaaaccctggaaactggtcatgcc

SEQ ID NO: 10056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccctacagcgtgtgggtggtggcagttc

SEQ ID NO: 10057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccgaacgacagctcatgtacggagggtc

SEQ ID NO: 10058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccgcgtatcttagacccattctgtaggg

SEQ ID NO: 10059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccgctaggacagaggccgcaaccctgtg

SEQ ID NO: 10060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccggaggatgggaactttttgaatgtta

SEQ ID NO: 10061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccggcacctatgggttgtcttactaagg

SEQ ID NO: 10062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccgggggattagccatcagcagcgtttg

SEQ ID NO: 10063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccggttcgacgtttgtagcgcaggtccg

SEQ ID NO: 10064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccggtttttacactcgccatggtaaatg

SEQ ID NO: 10065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaccgtacgttctgggacgtgctccccgac

SEQ ID NO: 10066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacctcctgctcacggccgtctagtaaacc

SEQ ID NO: 10067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacctgccgttcatgtccatttctaggtac

SEQ ID NO: 10068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgaagccttgagtggcgtaccacaggcg

SEQ ID NO: 10069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgaagtgttcatacctctcctctaattg

SEQ ID NO: 10070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgacgcttatataccactatgacccgag

SEQ ID NO: 10071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgacgggttcatcagccgctgggcaccc

SEQ ID NO: 10072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgagcggaccggggcgcctgacctccgg

SEQ ID NO: 10073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgagctcgctgagtagcgcgggggggtc

SEQ ID NO: 10074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgatcatgctgttctcgctaatatcgtc

SEQ ID NO: 10075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgcagctgtgcccggggcaagttaagcc

SEQ ID NO: 10076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgcattatatgccacctccctgtcatac

SEQ ID NO: 10077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgcctcataagcccgttaagcatccact

SEQ ID NO: 10078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgcctgggccagaatgggggtattcttc

SEQ ID NO: 10079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgcgacggtgccagagacaggtagttct

SEQ ID NO: 10080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgctcttatacataagctctcttttggc

SEQ ID NO: 10081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacggcgagcaggttttcaggggaattgtc

SEQ ID NO: 10082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacggctcggttctaaatgcttgatcatgg

SEQ ID NO: 10083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacggggaacgtttgtggttacgtccttac

SEQ ID NO: 10084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgggtggctaatgccagctgctggtgtt

SEQ ID NO: 10085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgggtggtccgaaagatgcatgcgggag

SEQ ID NO: 10086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacggtcaagagtggcgcgctggtgatagg

SEQ ID NO: 10087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacggtcccgctaacgcgatactccgtacg

SEQ ID NO: 10088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacggtttgctcgtggaggtttctatcgct

SEQ ID NO: 10089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgtagtagacggatgctggcaccggcgt

SEQ ID NO: 10090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacgtatttcgttaggtctggtcacgttat

SEQ ID NO: 10091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcactaacgatgggtgtggcctgcgaaacgc

SEQ ID NO: 10092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcactagatgaggtgcttcaatcgcgacagg

SEQ ID NO: 10093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcactatagagagattggtttgtaggccaaa

SEQ ID NO: 10094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcactccaatatgttaccagtatatgctctc

SEQ ID NO: 10095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcactgctttgttgttccgcctccacggctt

SEQ ID NO: 10096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcactggattatgttttcactggtactcgtt

SEQ ID NO: 10097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacttacgctacccacctatatttagagaa

SEQ ID NO: 10098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacttagggttagtgtaacagtgcggcgta

SEQ ID NO: 10099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcacttgcgcggtgctagtcctcaacatcgc

SEQ ID NO: 10100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcactttaagggcgaactcttcacgggaccc

SEQ ID NO: 10101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagacagatcgcggtgtatttctgtaggtg

SEQ ID NO: 10102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagacggcttcgacgtgcaacgcgcatagc

SEQ ID NO: 10103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagacggttcaccatcgcctgtctgcaggg

SEQ ID NO: 10104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagacgtgtttgctcaaacgcgcaattgtt

SEQ ID NO: 10105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagagagcagccaatctcgtagacgatccg

SEQ ID NO: 10106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagagcgatgggtggggtaagtggattttg

SEQ ID NO: 10107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagaggcttcgttcccgtaccttgtgatca

SEQ ID NO: 10108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagaggtcctttccttaaaggcgaaacact

SEQ ID NO: 10109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagaggtgtgatcgttaccgagctgagtcc

SEQ ID NO: 10110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagagtagggaaacaaaattccggtaactg

SEQ ID NO: 10111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagagtgggtgccggcctagtgttgggata

SEQ ID NO: 10112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagagttaatcgtctagacatgatctatgg

SEQ ID NO: 10113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagataccgaggaaattcgggtaatggatt

SEQ ID NO: 10114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagataggagggtagctcaacctgcagtcg

SEQ ID NO: 10115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagatatcaggaatcgactgaatggatacg

SEQ ID NO: 10116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagatcacaaagcccagaaagcgctatggg

SEQ ID NO: 10117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagatcatgcgtagcggtcgggcttgatta

SEQ ID NO: 10118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagatcccgcaccttcatctagctcccctg

SEQ ID NO: 10119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagattacagtaccgttaggttgcattact

SEQ ID NO: 10120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcaaatgtatcttagagagtatagaaca

SEQ ID NO: 10121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcaagcctcgattttgaactctctcgtc

SEQ ID NO: 10122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcaatgggtctggtggggcatttaagcg

SEQ ID NO: 10123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcaccattgatcgatcttaatcgtgcgc

SEQ ID NO: 10124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagccaatgaggtttaagatactgcttagg

SEQ ID NO: 10125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagccagccgaacgatcacaatcccgcccg

SEQ ID NO: 10126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcccttctgatttggaggatatctttga

SEQ ID NO: 10127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagccgacgtatcccccgtattgttcgtgt

SEQ ID NO: 10128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagccgatctcactactgtgaaaaccagcg

SEQ ID NO: 10129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagccggtagctacctagccattcgaacgc

SEQ ID NO: 10130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcctatttggtctcctccagtagtattg

SEQ ID NO: 10131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcctcgactgggcacacatttcgataaa

SEQ ID NO: 10132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcgggacactttgctccgaggacaggcc

SEQ ID NO: 10133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagcggggcggctgttttacagtgcaaagt

SEQ ID NO: 10134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagctgcactgttatctgagtgccaagtca

SEQ ID NO: 10135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggaaaagcgtgtgcaatatttgtagtag

SEQ ID NO: 10136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggaatatggcccggttgattggcggggc

SEQ ID NO: 10137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggaccgcgttacgtaagggctctggagc

SEQ ID NO: 10138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggaggctgggccgtggacagcgaagccc

SEQ ID NO: 10139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggagtgcttactgtttcttgaacgtcga

SEQ ID NO: 10140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggcgctacaggttatgggtggcgggagt

SEQ ID NO: 10141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggctaaagcggtactcgtttaggggtaa

SEQ ID NO: 10142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggcttcaggcgggtctgttcatcctact

SEQ ID NO: 10143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagggatggaagggattcgatgcaatgatt

SEQ ID NO: 10144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagggcggcgactatcctaacgcaattaca

SEQ ID NO: 10145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagggctaacaatgagcgttgttgttcact

SEQ ID NO: 10146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggggatcaaggaccggcctcaatcttct

SEQ ID NO: 10147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagggtatattgcaccgtctgcagtggggg

SEQ ID NO: 10148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggtagggttacttagtcccattttcata

SEQ ID NO: 10149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggtgactggtgaaagcatcgcgctcact

SEQ ID NO: 10150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcaggttattagacttgggcctccgcattcg

SEQ ID NO: 10151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtaaatgtgcaccaagaatccggggcgc

SEQ ID NO: 10152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtaacgttgtgtgtagcggaagttgtgg

SEQ ID NO: 10153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtagctccgtgtgctttttgggtgttcg

SEQ ID NO: 10154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtcaccgtacctccattacctagggcat

SEQ ID NO: 10155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtcagcggggtcaagcctgcgacagggt

SEQ ID NO: 10156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtccgttcttacaattccgggttaggag

SEQ ID NO: 10157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtcgaggctacctgacaaaccatgcgat

SEQ ID NO: 10158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtcgtctggatgtctaccagtaacgttg

SEQ ID NO: 10159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtctccgatttacgggctagacgttgcg

SEQ ID NO: 10160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtgcccaagaagatagtacggccacgaa

SEQ ID NO: 10161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtgggccagcgtaattcctgacattagc

SEQ ID NO: 10162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagtgtacagggtaccgtacactgcgcgag

SEQ ID NO: 10163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagttgaaagttgtgacaccggtggtattt

SEQ ID NO: 10164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcagttgcattggtggtacgaaaattggcgc

SEQ ID NO: 10165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcataagtgggacctaatccagagcaccggg

SEQ ID NO: 10166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatactcgattaagaatgcgtatacttcga

SEQ ID NO: 10167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatacttcgacgcgcgttcttttggtctcg

SEQ ID NO: 10168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatagaccggctgattctaaacatggcgcg

SEQ ID NO: 10169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatagcattggcgatgggctggctgtagtg

SEQ ID NO: 10170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatataatcatcgacgtacacacgatcacg

SEQ ID NO: 10171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatataggatgcaaactgaataggatttcg

SEQ ID NO: 10172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatatggcaggctctcatcacctttgagcg

SEQ ID NO: 10173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatattcggaacagccgtcttagttgtgat

SEQ ID NO: 10174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcaaccatagggtcttaaacaatacacg

SEQ ID NO: 10175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcaagcggagtgaaaactcagtatgcca

SEQ ID NO: 10176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcaggatccgtatccatgactgcagatg

SEQ ID NO: 10177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcatagagccccttgcattgctagtggg

SEQ ID NO: 10178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatccagggatgcatcctcgcgcggtttcg

SEQ ID NO: 10179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatccgcgtcacccactcacacatggttta

SEQ ID NO: 10180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatccggcgcgacctggggacagacttttc

SEQ ID NO: 10181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatccgtcccgatactcaacattgattggc

SEQ ID NO: 10182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatccgtccgttctcgggggcattcttgtt

SEQ ID NO: 10183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatccgttctttcaagtcatcgactcgcta

SEQ ID NO: 10184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcctgacacggcttgcgatgttcgcagt

SEQ ID NO: 10185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcggatgtctctacaatgcacgcggagc

SEQ ID NO: 10186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatctgagtgttgtcgacaggcatgagcat

SEQ ID NO: 10187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcttataatgcttttggggcaatcggag

SEQ ID NO: 10188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatcttatctcaggggtggatgtctatgtt

SEQ ID NO: 10189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgaaccaccccgccggacgtttgcttag

SEQ ID NO: 10190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgaagtcttactcatcacgcaagcatca

SEQ ID NO: 10191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgcaatagtcgagggaattttgagattt

SEQ ID NO: 10192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgcagcccgcgctctctgctacaccttt

SEQ ID NO: 10193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgcagcgggctctctcttcctgtagccg

SEQ ID NO: 10194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgcagtacacgccgatagtttctgcgcc

SEQ ID NO: 10195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgcatcatactgggcggtctgattttca

SEQ ID NO: 10196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgcccaacgtataggagcttgtgtcgga

SEQ ID NO: 10197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgcggcacgcatgtataattctagtgcg

SEQ ID NO: 10198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgctgggatttcctgtcgcactttaacc

SEQ ID NO: 10199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatggacttagggctttagtcttcgcgcgt

SEQ ID NO: 10200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatggagggctgagtatgcggtatgtgcgc

SEQ ID NO: 10201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgggaggggaccagactctttctttgac

SEQ ID NO: 10202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatggggacctataccgtcacacggggggt

SEQ ID NO: 10203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgggtttacagctgcaacctcgctcgca

SEQ ID NO: 10204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatggttagagcgacagcacgcaggagtcg

SEQ ID NO: 10205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgtggttacgcgatagttttgcgagcgt

SEQ ID NO: 10206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgtgtttcgagggcatggtggctatcct

SEQ ID NO: 10207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgttcaccggactcgttcatacagtttc

SEQ ID NO: 10208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatgttcatgtgaccggtcaactttcaaga

SEQ ID NO: 10209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattacctgtgtagaagggtgcatcgtaac

SEQ ID NO: 10210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattatatgagtggaactacttgtggccat

SEQ ID NO: 10211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattccacaaagccgggtaaggcgaagctt

SEQ ID NO: 10212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattcccttggcgtaagatatgagtcagcg

SEQ ID NO: 10213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattcggcttggtgtagcgggagcgttagg

SEQ ID NO: 10214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattctgcgaagtgtcgaatcacggtcgca

SEQ ID NO: 10215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattgatatgggcacccaaatgcaggggaa

SEQ ID NO: 10216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattggagtcttaggcctagccgccagggt

SEQ ID NO: 10217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattgtaccagtcaagtgtcaaatccgtgc

SEQ ID NO: 10218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcattgttcgtggccatagtctcgattagtg

SEQ ID NO: 10219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatttgggctgcggttcgtgctccagtgtg

SEQ ID NO: 10220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcatttggtggtgtggcaggtgtcatgagta

SEQ ID NO: 10221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaaacgggcccggcgactatccatttgcc

SEQ ID NO: 10222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaaacgggggtcatactcatgcattgagg

SEQ ID NO: 10223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaaacggttaccagtatcatgcagggcgg

SEQ ID NO: 10224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaacacgcttaattcacggcgccacgagt

SEQ ID NO: 10225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaaccggaacggcgacggcgttgcgtttc

SEQ ID NO: 10226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaagcgggacaaggaaatgcaatgggatg

SEQ ID NO: 10227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaaggacgataacatagtcgtcgccggat

SEQ ID NO: 10228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaagggtgctttgcgttgtatttacttgc

SEQ ID NO: 10229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaatctagtggtgataccgggctatgttg

SEQ ID NO: 10230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaattcagcggcgaaatattgagcacgta

SEQ ID NO: 10231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaattcctcgagtctttcgtcgatttggt

SEQ ID NO: 10232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacacagcgattttcaggtgctgacgtcg

SEQ ID NO: 10233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacacctgaggcggtcggagatagagtta

SEQ ID NO: 10234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacacgccgttcgaaaccgtgtccaggga

SEQ ID NO: 10235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacagccgtgaatgtttacgtccgtcggt

SEQ ID NO: 10236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaccaagcggtcccatctgcacggtaatg

SEQ ID NO: 10237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaccactaccaacaagtaaagtgcgtgac

SEQ ID NO: 10238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaccatggcgttttaagaggcgaccgggg

SEQ ID NO: 10239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaccccactgagcaggcccaccaatattc

SEQ ID NO: 10240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacctatgtggaaacaggtcgcgactaag

SEQ ID NO: 10241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacggagcgtactagctgtggtatgggcc

SEQ ID NO: 10242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacggccactcaaactctgtcggtgtttt

SEQ ID NO: 10243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacggcttagtttggtgcggcctttggac

SEQ ID NO: 10244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacgggtggttgctagcgatgacttggga

SEQ ID NO: 10245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccacgtgggccgaaacctgtactgccgggc

SEQ ID NO: 10246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccactatcatgtgatgaatttcccgcgccg

SEQ ID NO: 10247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccactggccgacctacgcatggtatggtcc

SEQ ID NO: 10248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccactggttgagattatttatagtctgcga

SEQ ID NO: 10249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagagcccgcgtcctgttacaataggccg

SEQ ID NO: 10250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagcaaatcccattgagtctcaccagcac

SEQ ID NO: 10251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagcatccagggattatctcttatcgcgc

SEQ ID NO: 10252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagcgattgagtgtcagaatctagagacg

SEQ ID NO: 10253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagcgcaaacataccatcaatttgacggc

SEQ ID NO: 10254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagcgcatgctcctgttatccaggtacac

SEQ ID NO: 10255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagcggagccacttggaggtttgctggac

SEQ ID NO: 10256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagcgttgtttcacctcagcctcaacgcg

SEQ ID NO: 10257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaggatcggattatcgaccgttatgcagt

SEQ ID NO: 10258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagggaacgaggcatgaacgtgcgtgcac

SEQ ID NO: 10259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccaggggccgcgtactttagcctctagtct

SEQ ID NO: 10260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagtgaatgcttgtcacgcgttctcagca

SEQ ID NO: 10261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccagtgttcgcttgatcgggtggtagagcg

SEQ ID NO: 10262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatacagtgtttcgtgtcgtagagttgcg

SEQ ID NO: 10263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatcaacgatctgcttgagtgctctgcca

SEQ ID NO: 10264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatcagttgacgttggcaagagggtgtga

SEQ ID NO: 10265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatcataggtctctcgtcggtattacgcg

SEQ ID NO: 10266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatctcctctgcgcgctgcactctcaacg

SEQ ID NO: 10267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatctgtgttaacgaggtttaccttctgg

SEQ ID NO: 10268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatgataaggtgttacgatggctcgcgta

SEQ ID NO: 10269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatgcacaattatcttccacgaccggttc

SEQ ID NO: 10270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatgcagcagagccttatgtaggcggtgc

SEQ ID NO: 10271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatggcgatgcacaatgccactcgtgggg

SEQ ID NO: 10272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatggtccagactaactgagcaccgttta

SEQ ID NO: 10273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccatgtcaaccgaggcgtattcattcgtgg

SEQ ID NO: 10274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccaaagtatactgctcgtgacattgccta

SEQ ID NO: 10275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccaacaagactgtttgctccatacggaac

SEQ ID NO: 10276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccaaccatgtggctaagatccatgcagtg

SEQ ID NO: 10277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccaatgaatgaagtctcgctagtgcaata

SEQ ID NO: 10278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccacggtatggggcgttggtctgtttccg

SEQ ID NO: 10279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccacgtgtcgttacgccgttccttaggag

SEQ ID NO: 10280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccactggcaagacgaccatcaggctggcg

SEQ ID NO: 10281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccagaggttagggggcaccagttcattga

SEQ ID NO: 10282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccagcaattcatttgcaacgactgaccga

SEQ ID NO: 10283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccagcctctatgcaccgccggcatgtcgt

SEQ ID NO: 10284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccaggcccaaccattttcatgtcttatgt

SEQ ID NO: 10285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccagtactccatcttcgtagctggatctg

SEQ ID NO: 10286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccagtccccttgctagtactttgtccaga

SEQ ID NO: 10287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccatcgtcggcggttaccatgcatgtaga

SEQ ID NO: 10288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccatgcaggactctatctttgctacgtgt

SEQ ID NO: 10289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccattcctggacctggactgtcgggttct

SEQ ID NO: 10290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccaaggcaagtggctggtactctcgtct

SEQ ID NO: 10291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccacgaggcactcccactctgaggtcgg

SEQ ID NO: 10292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccagccccaggacgaatccatcgttctc

SEQ ID NO: 10293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccaggtggacaatgttccggtatcctgc

SEQ ID NO: 10294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccagtttgctcggcgcctgctaagtctg

SEQ ID NO: 10295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccatacagggagggatagccgaaaaacg

SEQ ID NO: 10296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccccatcccacatgttcaaatgacgtgga

SEQ ID NO: 10297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccccggaacaatttggtgcataaaccgac

SEQ ID NO: 10298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccctcttagttgagctcgtttattacga

SEQ ID NO: 10299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccgaactggactcacccctgttggtgga

SEQ ID NO: 10300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccgacgtgcctagtcaggttcgcgtgac

SEQ ID NO: 10301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccgcccatgtgagtagttcagcgtggtc

SEQ ID NO: 10302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccggacttccgagttggctgactccctt

SEQ ID NO: 10303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccgggcccattcctgcgctggcctgtga

SEQ ID NO: 10304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccccggtggttatgcttacaccagtctctc

SEQ ID NO: 10305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccctgacggtaaacctcccacgcacccac

SEQ ID NO: 10306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgacggcactttgttgggtataagctgg

SEQ ID NO: 10307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgagcagagcccgaggaatctggcccac

SEQ ID NO: 10308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgatgaacgttattgtaatttgattcga

SEQ ID NO: 10309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgattgggcccagatttgcccggcgctc

SEQ ID NO: 10310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgccactcgttccgtcaccttatacccc

SEQ ID NO: 10311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgcgacactgctgactgtgctttgtggt

SEQ ID NO: 10312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgcggctcaccagcggcgacatcgggtt

SEQ ID NO: 10313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgcggtcgcagtcgatagagcccggaat

SEQ ID NO: 10314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgctggttctctcgcgcgttataatagg

SEQ ID NO: 10315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgcttgtacggtcatacggccggcgggc

SEQ ID NO: 10316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccggacaggcgaaatgctgtgtattggtg

SEQ ID NO: 10317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccggacggcttgttaggtccattttcacg

SEQ ID NO: 10318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgggaaaccattgttcagtagccgtgcg

SEQ ID NO: 10319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgggcactcatatgccgagttgtgtggg

SEQ ID NO: 10320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccggtcgagctttcatcccgcgtctcggg

SEQ ID NO: 10321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccggtcgatcggtcgcaatgtgcgcgctg

SEQ ID NO: 10322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgtagcttaggacgtacctataaccact

SEQ ID NO: 10323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgtcggaggagcggtcactgtgaggtcg

SEQ ID NO: 10324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgtctcccaaaccagcattacactctac

SEQ ID NO: 10325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgtggggtgcttcagacatgtttgttat

SEQ ID NO: 10326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgttatggcaaggctttaactggttggc

SEQ ID NO: 10327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcccgttgaactcatagaaagtccatggagt

SEQ ID NO: 10328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctaaggcatttattgaggctgaacggtt

SEQ ID NO: 10329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctacggctctgctcgaacggtcctggtg

SEQ ID NO: 10330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctattcttggcggcgctgttattgatgg

SEQ ID NO: 10331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctcacgtgggtaaactcttacgcggctc

SEQ ID NO: 10332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctcagaacatcaactttgtaagagcttc

SEQ ID NO: 10333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctggaaccgtgtaggtccactacggcgt

SEQ ID NO: 10334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctggggtcttcgggtcgctacgggcctg

SEQ ID NO: 10335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctggtaactgtcgcggcaactcagactt

SEQ ID NO: 10336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctgttgccagttttataaccactgtccg

SEQ ID NO: 10337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccctttcgttgtgctaaggcgctaatcagg

SEQ ID NO: 10338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgaacgttcacagcgcggtcgtccacgcc

SEQ ID NO: 10339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgaatcttcacggtgaaggtggaatatcc

SEQ ID NO: 10340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgacagcgtggataactgcttattgatga

SEQ ID NO: 10341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgacccgcaatcaaataccttcgggcgac

SEQ ID NO: 10342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgacccgttggatgctcgttttatgcgac

SEQ ID NO: 10343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgacgcattcgagggagggaggtttggtg

SEQ ID NO: 10344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgacgtactttttggcaagtatagaattg

SEQ ID NO: 10345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgagccgtggtaaacgcagtcgaatagtt

SEQ ID NO: 10346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgagcgaatgtcattagttctccgccgtc

SEQ ID NO: 10347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgaggaatctccctcttgattctgggtta

SEQ ID NO: 10348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgataactctgagaaaaggggtgtcgccg

SEQ ID NO: 10349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgatcccggggacccgtttgagcatgggt

SEQ ID NO: 10350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgatctacggcgaaacactttacgtttgg

SEQ ID NO: 10351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgatgaggtcccaaaacccgacttcacgc

SEQ ID NO: 10352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgatggcgacttggtagtcatcgacgcca

SEQ ID NO: 10353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgatggtgaagtctccggactgtttctgg

SEQ ID NO: 10354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgatgtaagttgacaatggtatttgggcg

SEQ ID NO: 10355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgatgtctagcaaaaagtatctgtcctgc

SEQ ID NO: 10356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgattaatcgcctaaccctctccatacaa

SEQ ID NO: 10357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgattgtcttatcgtaactagttgctata

SEQ ID NO: 10358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcacgctaagacaatacccttcagctcc

SEQ ID NO: 10359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcacgtccaattccctgcctgttgattt

SEQ ID NO: 10360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgccagtaaattcaatccagtttgaacgg

SEQ ID NO: 10361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcccaccgaagtgcatttggcctattcg

SEQ ID NO: 10362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcccctaaaacattccggcgaaccttcc

SEQ ID NO: 10363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcccgaatctggcttcaaataccctacc

SEQ ID NO: 10364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgccctgactttaaagcgttcttgaatag

SEQ ID NO: 10365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcccttccatgggggcactcgtggcggg

SEQ ID NO: 10366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcctcaggttaaaggtaccggtcgtcct

SEQ ID NO: 10367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcctcgcccactcaacactccatctgaa

SEQ ID NO: 10368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcctggagtcctcggaggattctgcaac

SEQ ID NO: 10369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcctttaatgccacatcagtacttggga

SEQ ID NO: 10370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcgacttctttagtccccaatgagcact

SEQ ID NO: 10371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcgcgaccacttgcggcgtctttgccac

SEQ ID NO: 10372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcgtcaggcactcaagatttcaggcaca

SEQ ID NO: 10373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcgttctggtcggcttgtattgtgcatt

SEQ ID NO: 10374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgctatgtaacgcactgtcgataggagca

SEQ ID NO: 10375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgctggtttccgggggaccatctgcgtat

SEQ ID NO: 10376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgctgtaccgagtgcgtatggcaagggtg

SEQ ID NO: 10377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgctgtctcagtacccatgtgctagagtt

SEQ ID NO: 10378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgcttgggcctaattctcgggcgcttatg

SEQ ID NO: 10379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggaacagatttcagctggtcttgacttt

SEQ ID NO: 10380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggaagtgtggatggtccctttgatagcg

SEQ ID NO: 10381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggacggacataatctaaaacaggagcgt

SEQ ID NO: 10382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggaggtttgagcacgtggtcttgtcaat

SEQ ID NO: 10383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggataaagacattggccaacatgcgcgg

SEQ ID NO: 10384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggcccgatgcttaaccctcgactagcgc

SEQ ID NO: 10385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggcgccagaggggtacaaggggacgatg

SEQ ID NO: 10386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggcgtacggacatagccaccttggccca

SEQ ID NO: 10387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggcttttgtcttgtggttaggttatagg

SEQ ID NO: 10388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgggactggggatagtacggctggcactc

SEQ ID NO: 10389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgggctccaagggacgttgcctttgcgcg

SEQ ID NO: 10390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggggactgttgagaagcccacacgtgca

SEQ ID NO: 10391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgggggaatgcgtttgcgattcgggaagg

SEQ ID NO: 10392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgggtggactcttccggctttagcgagag

SEQ ID NO: 10393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggtaaacggactttgctcttttaaaaac

SEQ ID NO: 10394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggtagaacgccaccgcttatgaagtttc

SEQ ID NO: 10395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggtcactccacttcttcagatctgtcgg

SEQ ID NO: 10396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggtgacgtgccagagaccagtgcaccac

SEQ ID NO: 10397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggtggcccagtgaacgtccaggggctgg

SEQ ID NO: 10398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggtggtcagagaagggctacgagagggt

SEQ ID NO: 10399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggttaatcaaatgcatcgataagagatg

SEQ ID NO: 10400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggttcgatattggatattatagccgtcc

SEQ ID NO: 10401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccggttgcacgttactactctggcccgcgt

SEQ ID NO: 10402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtacatccatcgtaaacaactgtgcgca

SEQ ID NO: 10403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtagtgatagatcggggggaaccatttg

SEQ ID NO: 10404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtatgaaaagcgctccttggcggggatt

SEQ ID NO: 10405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtcactctgtcccgcccaactgacacta

SEQ ID NO: 10406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtcgacagggtcctgcggaaaatctggt

SEQ ID NO: 10407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtcgcaagccctgtatggactatggtgg

SEQ ID NO: 10408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtgcagtcaccggtggaagaagcgtgtt

SEQ ID NO: 10409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtggtatgcagacgggcggacacaagca

SEQ ID NO: 10410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtggtcaaggtcatgcagcagcgggagt

SEQ ID NO: 10411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtggtctaagtccactcttcctcttgct

SEQ ID NO: 10412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgtgtaaggctctaaatcgatctaggtga

SEQ ID NO: 10413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccgttttcggagcagcgctaggctcggcaa

SEQ ID NO: 10414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctaaactgtgattttaaggcacactggga

SEQ ID NO: 10415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctaaccccctctggccgtagacgcatggt

SEQ ID NO: 10416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctacacggcttgttcgggggggcgttcgt

SEQ ID NO: 10417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctacgttagctgcaggcgccggggcttta

SEQ ID NO: 10418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctagtaccgagagcgtgggccactccact

SEQ ID NO: 10419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcacaaatactcgtaggtatgaataagc

SEQ ID NO: 10420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcacgcatacagtcataaggttacgagt

SEQ ID NO: 10421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctccagtcggacaaccgcctagtctgctt

SEQ ID NO: 10422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctccgactcgcgtttttatggggattcga

SEQ ID NO: 10423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcgataggatacgcacaggtggtggttc

SEQ ID NO: 10424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcggcagcgtttatcggaggggggcaaa

SEQ ID NO: 10425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcggccaaactgcgaacaatgttcattt

SEQ ID NO: 10426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcggtcgaggcgtattccctcgcacaac

SEQ ID NO: 10427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcgttttatgcccgtgtgggtggccttg

SEQ ID NO: 10428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctctcgcacgactctgtgggatgcggcct

SEQ ID NO: 10429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctcttcaagggtggctactgaacattagt

SEQ ID NO: 10430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgaagatgcctcgaggagtcagcccggc

SEQ ID NO: 10431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgacttctgggcggtacattaattatcg

SEQ ID NO: 10432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgagctacagtggttggtcgatttaccg

SEQ ID NO: 10433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgcattcgacttgcgtccacactaacgt

SEQ ID NO: 10434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgcctcagttctttggattttccggatg

SEQ ID NO: 10435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgcggcgttctcgtgaattggacatgga

SEQ ID NO: 10436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgcgtttgctaattcaataaacctcccg

SEQ ID NO: 10437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgctcggtgctagggaatattctttcaa

SEQ ID NO: 10438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctggcagattctcgggaccgtttttagtt

SEQ ID NO: 10439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctggcatcacgcgtggtggtttgatagtc

SEQ ID NO: 10440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgggctgaacaagagtcacggcatcagg

SEQ ID NO: 10441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgggcttccttgttctacttgaccttta

SEQ ID NO: 10442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgggtagccggcgcgtcggtgctcgaaa

SEQ ID NO: 10443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgtaacggtgaacgcgtcttccttgttg

SEQ ID NO: 10444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgtaagttgccgcgaccggtagtaactg

SEQ ID NO: 10445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgtcacagccccaatgccgcggttgaac

SEQ ID NO: 10446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgtcatggcgttaagttacccaagaaat

SEQ ID NO: 10447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctgtggacgcctttctgaattgttgcgta

SEQ ID NO: 10448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccttaatctgatgccacctggtatacaaca

SEQ ID NO: 10449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccttagtagtcaacttgcaaattcgctact

SEQ ID NO: 10450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccttcaacagctcggatgtgatctatccat

SEQ ID NO: 10451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccttcttcgtccacacggctctgccctcta

SEQ ID NO: 10452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccttgtataaccgatcgtccagtgcggcct

SEQ ID NO: 10453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccttgtgtctaagctggtggtggttggccg

SEQ ID NO: 10454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atccttgtttttcaagcactggtcacacactg

SEQ ID NO: 10455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctttacgatccgctccgatgtaactggtg

SEQ ID NO: 10456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctttggccgccgcgtccaatattgttacg

SEQ ID NO: 10457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcctttttcgctccagtagcttgcattcatc

SEQ ID NO: 10458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaaccataaagctacactttcagacgccg

SEQ ID NO: 10459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaacgggcggccaggaatgaaggggttcc

SEQ ID NO: 10460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaactatggatccgtaacatgttgacgat

SEQ ID NO: 10461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaagcagtggatctccgcccgtgttatcc

SEQ ID NO: 10462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaatactcggagtctacagttgtccatac

SEQ ID NO: 10463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaatatccggccataatgggagcgctgct

SEQ ID NO: 10464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaattgatacactggggtcaaagtcatgc

SEQ ID NO: 10465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacacagcctgacagccatagttgccgcg

SEQ ID NO: 10466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacacaggcaaaccttcataccgaggtat

SEQ ID NO: 10467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacatcaggaataagtgccttgtggagtg

SEQ ID NO: 10468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacccgttctcgtgtgtcttcggtcatcc

SEQ ID NO: 10469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaccggcgccatgtaacattgtacagggc

SEQ ID NO: 10470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacgaatggggctggcctttatcttagta

SEQ ID NO: 10471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacgcgcaacggcctgtgtcactgcaagc

SEQ ID NO: 10472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacgcggccactcctagttgggtcacgat

SEQ ID NO: 10473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgacggttaacggccaatgcgactgaacac

SEQ ID NO: 10474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgactattcattgactcggggtgtgtacga

SEQ ID NO: 10475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgactcggatacctcgaagcacggccgtag

SEQ ID NO: 10476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgactgggtcattaggactatgttcaggtg

SEQ ID NO: 10477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgactgtctagctttaattcttgttcgcct

SEQ ID NO: 10478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagaacggtgccttcggggacagcgccat

SEQ ID NO: 10479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagaagcctggagcagctttacttgcacg

SEQ ID NO: 10480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagaaggtgagcgtcttagcatgccctcg

SEQ ID NO: 10481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagacccgttgattgatgagtgcatgggt

SEQ ID NO: 10482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagacttgggtcacaacgcacaccgacac

SEQ ID NO: 10483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagcacaacagtcgccgggagaacggaga

SEQ ID NO: 10484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagctcgtgtgcgtcggagggccactttc

SEQ ID NO: 10485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaggcacggcatcgctgccatataggcac

SEQ ID NO: 10486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaggctaatgtgttgtccttgctcctgtc

SEQ ID NO: 10487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagggcccagttggctccgcttccggtag

SEQ ID NO: 10488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagggcctgagcgtcgtgcattattgtgt

SEQ ID NO: 10489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagggtatcgtttgcaccggaatcgtgga

SEQ ID NO: 10490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagggtcagtggtccatgaggggttcacg

SEQ ID NO: 10491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgaggtgtcggaggtaatcacgattatcgc

SEQ ID NO: 10492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagtagtgcgtggtcggcaaggtggtggc

SEQ ID NO: 10493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgagttgtccacaggggtacccaccagcgg

SEQ ID NO: 10494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgataagtcggcaaccgtagatgacagttc

SEQ ID NO: 10495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatccccatactcctgctcaaggtgtggg

SEQ ID NO: 10496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatccttttccattacgccacttaagccc

SEQ ID NO: 10497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatctaaccaaggtttcacgggtcgggcc

SEQ ID NO: 10498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatggcgaaattagaaactttatttgacg

SEQ ID NO: 10499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatggcttcttttgtgttggtgcggtcct

SEQ ID NO: 10500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatgtctgggtaggtgccgggcctcacgt

SEQ ID NO: 10501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatgttctgggctacagtggttctcacgc

SEQ ID NO: 10502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgatgttgtagttgtgctagtacactgaag

SEQ ID NO: 10503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgattcagaccaggtcgcttgagactctcg

SEQ ID NO: 10504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgattcatttcaagagttgagttcgatcgc

SEQ ID NO: 10505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgattgtttctttcgttagagtcttagcgg

SEQ ID NO: 10506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaaagcatcgggggtatgaaaccgcttc

SEQ ID NO: 10507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaacaattgtcagccgatcatttaattt

SEQ ID NO: 10508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaacacgacagtggccgttcggacaggc

SEQ ID NO: 10509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaactgtcacatctcgcagtactagttt

SEQ ID NO: 10510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaagagaccggcagagttacgaacgggc

SEQ ID NO: 10511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaaggtaatcgaaagtcgatgctccccg

SEQ ID NO: 10512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaagttacactgcatatgtttaattcga

SEQ ID NO: 10513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaatcttgttttccgttggccatatgta

SEQ ID NO: 10514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcacaaagatcttcacgccgccttgggtc

SEQ ID NO: 10515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcacacggcaagaccaagtagacggtatg

SEQ ID NO: 10516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaccaagaaaggctgcatctgtcgagct

SEQ ID NO: 10517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaccgcttgcacattacgctcagacctc

SEQ ID NO: 10518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaccgtgatcaaggagaaggcagcactg

SEQ ID NO: 10519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcactactctcccgacgagatttaccgat

SEQ ID NO: 10520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcagacaagagcatctgtgcacttttcgc

SEQ ID NO: 10521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcagcagccgcacccgcttggttgtctac

SEQ ID NO: 10522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcagcagtatgtgctattactgttattta

SEQ ID NO: 10523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcaggagcccagccgtgttattccagggc

SEQ ID NO: 10524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcatcgcttagtatgaggggcatatcgtt

SEQ ID NO: 10525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcattaagatgtcggctgccttctaacgt

SEQ ID NO: 10526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccacaactatttttcctctcatgtaatc

SEQ ID NO: 10527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccacttagactatgtgcataactcaaca

SEQ ID NO: 10528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccagttagaatggacatgcttcaccaag

SEQ ID NO: 10529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccatcaccgcattacatggtcatccgca

SEQ ID NO: 10530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcccagtacaggctttgagagtgggacca

SEQ ID NO: 10531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcccccgggtagtcggagcttgtggtgtg

SEQ ID NO: 10532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccccgatcagtcgtacggtggcccaagg

SEQ ID NO: 10533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccccgtgaaggcatacatcataattaaa

SEQ ID NO: 10534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcccgcagacatcgcggagatgtggtcct

SEQ ID NO: 10535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccctgactattgaagtgtggaccacttc

SEQ ID NO: 10536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccgcagggtggcctacatacggttatcg

SEQ ID NO: 10537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccgccattcaattttaagctgaatttgc

SEQ ID NO: 10538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccggactggtgatcttcattgatgcggt

SEQ ID NO: 10539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccggtgatatcagttaaatcttgcgtcg

SEQ ID NO: 10540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccgtatggcgtagctcatgttttgtgcc

SEQ ID NO: 10541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcctacaaagaatgttgcccatttcgagc

SEQ ID NO: 10542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcctagagctgttttatgaccattggcat

SEQ ID NO: 10543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcctagcataactgcaggatttcccgtac

SEQ ID NO: 10544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcctccccccagtcagcaacgcgctcgtc

SEQ ID NO: 10545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcctgacgttagtccaaaccgactggttt

SEQ ID NO: 10546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccttaccgagtgtacaggggcaacccgt

SEQ ID NO: 10547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgccttgtacaatctgcgatgtttagcctc

SEQ ID NO: 10548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgaaagcggtgccacatcgtttgcggcc

SEQ ID NO: 10549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgaacggtttaacttttggggttggcgg

SEQ ID NO: 10550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgacttcggagagcgtttggttacgacg

SEQ ID NO: 10551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgagaaattcagtggttaaacgcgggca

SEQ ID NO: 10552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgagacatcgtctgggaagcgatgttta

SEQ ID NO: 10553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgatcaatgcgtacgggtcttttatgtc

SEQ ID NO: 10554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgcatactgaagtccatcgttaccgggt

SEQ ID NO: 10555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgccatgtcatggattaggtctattgtc

SEQ ID NO: 10556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgccgtgcgtaccgagatctacccactt

SEQ ID NO: 10557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgcgcagcggaggttactcttccttgag

SEQ ID NO: 10558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgcgcgcatgaggtgcttcgctccatcg

SEQ ID NO: 10559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgcgggcaaacgaaagcatgcacggttc

SEQ ID NO: 10560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcggagtcaattgtcctgccagcgacggc

SEQ ID NO: 10561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcggcgctcggatcgtgtgcggttttcgt

SEQ ID NO: 10562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgggggtcagacgaagttgtaacctctc

SEQ ID NO: 10563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcggtaaggaaatcgtcgcgggcagggct

SEQ ID NO: 10564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgtaggccaacctttttcctgcccacat

SEQ ID NO: 10565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgtcagagagagccagtctctcttcgta

SEQ ID NO: 10566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgtcgatcgtcttgaggtagagccaacc

SEQ ID NO: 10567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgtgttgtttccaattgcctgtttgcaa

SEQ ID NO: 10568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcgtttcgttggcaataactgttatttct

SEQ ID NO: 10569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctactgctaatccgagccttgcgacaaa

SEQ ID NO: 10570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctagtatccttggacgacgggtaatagc

SEQ ID NO: 10571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctagtggatcgggggagtgtttcctcgg

SEQ ID NO: 10572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctgctcacacggatctacattagccctc

SEQ ID NO: 10573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctgcttatctcatggaatcatcttcgcc

SEQ ID NO: 10574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctgggagtaattggctcgggcggctgcg

SEQ ID NO: 10575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctggttcatccatggaaccgccgtgctt

SEQ ID NO: 10576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctgtaaacggactggcattttggttttt

SEQ ID NO: 10577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctgtatcttgtccgtggtttcacgcggt

SEQ ID NO: 10578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctgtgggtcaacggatcaacatagtctg

SEQ ID NO: 10579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgctttctttggaacactgactcacattcg

SEQ ID NO: 10580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgcttttggtcctattggtcgacgtaggct

SEQ ID NO: 10581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaacggcggaagggcatcgggctgtgag

SEQ ID NO: 10582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaagtcgtcggtgttcaccagcagacct

SEQ ID NO: 10583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggacaagcatgcaagttggttatgtatgt

SEQ ID NO: 10584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaccatcaaatctatggatcctatttac

SEQ ID NO: 10585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaccggaacttaggcgacgatggtataa

SEQ ID NO: 10586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaccggatctctcttcattaagcgttgg

SEQ ID NO: 10587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaccggatgggcaaccgcgaacgtcgcg

SEQ ID NO: 10588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggacgaccgagttgagttcgcctgcggtt

SEQ ID NO: 10589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggacggaagcatctaaacggtcggaacga

SEQ ID NO: 10590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggactcgtttgattgcgtatcaccccgga

SEQ ID NO: 10591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggactgccacgggttttatgtaatgcgct

SEQ ID NO: 10592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggacttctaggtacttgcaagatagttca

SEQ ID NO: 10593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggagactcgcaggaagttacctgttctat

SEQ ID NO: 10594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaggattaccgctagtgccgatgttagg

SEQ ID NO: 10595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggaggcatatacttgtcttgtgctgcctc

SEQ ID NO: 10596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggagtctccatcgtgcaatcgggcgctag

SEQ ID NO: 10597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggagtggcacccttgcacgtagtgctgcc

SEQ ID NO: 10598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggagtttgtatgcggttttcaactcgcga

(The sequence listing continues in the following parts.)

What is claimed is:

1. A method of detecting a microvesicle population in a biological sample, comprising:
   (a) providing a plurality of oligonucleotide aptamers that is predetermined to form a complex with microvesicles;
   (b) contacting the biological sample with the plurality of oligonucleotide aptamers provided in (a);
   (c) detecting a level for each member of the plurality of oligonucleotide aptamers that formed a complex with microvesicles in the biological sample in (b) by sequencing the plurality of oligonucleotide aptamers; thereby detecting the microvesicle population.

2. The method of claim 1, wherein the plurality of oligonucleotide aptamers are predetermined through at least one step of positive selection, negative selection, or both.

3. The method of claim 1, wherein the sequencing in step (c) comprises high-throughput sequencing.

4. The method of claim 1, wherein the biological sample is from a subject suspected of having or being predisposed to having a cancer.

5. The method of claim 4, wherein the cancer comprises an acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer; childhood cancers; chordoma; chronic lymphocytic leukemia; chronic myelogenous leukemia; chronic myeloproliferative disorders; colon cancer; colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioma; hairy cell leukemia; head and neck cancer; heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer; lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer; papillomatosis; paranasal sinus cancer; parathyroid cancer; pelvic cancer; penile cancer; pharyngeal cancer; pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer; retinoblastoma; rhabdomyosarcoma; salivary gland cancer; Sezary syndrome; small cell lung cancer; small intestine cancer; soft tissue sarcoma; squamous cell carcinoma; squamous neck cancer; stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer; vulvar cancer; Waldenström macroglobulinemia; or Wilm's tumor.

6. The method of claim 1, wherein the biological sample comprises a tissue sample, a cell culture, or a biological fluid.

7. The method of claim 6, wherein the biological fluid comprises a bodily fluid.

8. The method of claim 7, wherein the bodily fluid comprises peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood.

9. The method of claim 7, wherein the bodily fluid comprises blood, serum or plasma.

10. The method of claim 1, wherein the biological sample is contacted with the plurality of oligonucleotide aptamers before isolating microvesicles.

11. The method of claim 1, wherein the biological sample comprises isolated microvesicles.

12. The method of claim 1, wherein the members of the plurality of oligonucleotide aptamers form a complex with polypeptides or fragments thereof.

13. The method of claim 12, wherein the polypeptides or fragments thereof are soluble or membrane bound.

14. The method of claim 12, wherein the polypeptides or fragments thereof comprise microvesicle surface antigens.

15. The method of claim 1, wherein the plurality of oligonucleotide aptamers comprises at least 5 different oligonucleotide aptamers.

16. The method of claim 1, wherein the plurality of oligonucleotide aptamers comprises at least 10 different oligonucleotide aptamers.

17. The method of claim 1, wherein the plurality of oligonucleotide aptamers comprises at least 20 different oligonucleotide aptamers.

18. The method of claim 1, wherein the microvesicles are isolated using chromatography, filtration, ultrafiltration, centrifugation, ultracentrifugation, flow cytometry, affinity capture, microfluidics, polymer precipitation, or any combination thereof.

* * * * *